United States Patent 7,745,391 (HUMAN THROMBOSPONDIN POLYPEPTIDE) - sequence listing, part 85

SEQ ID NO: 290139 - DNA, 2459 bp, Homo sapiens
ggtcagtagccagacatgagctgtgagggtcaagcacagctatccatcagatgatctactttcagccttcctgagtcccagacaatagaagacaggtggctgtacccttggccaagggtaggtgtggcagtggtgtctgctgtcactgtgccctcattggcccccagcaatcagactcaacagacggagcaactgccatccgaggctcctgaaccagggccattcaccaggagcatgcggctccctgatgtccagctctggctggtgctgctgtgggcactggtgcgagcacaggggacagggtctgtgtgtccctcctgtgggggctccaaactggcaccccaagcagaacgagctctggtgctggagctagccaagcagcaaatcctggatgggttgcacctgaccagtcgtcccagaataactcatcctccaccccaggcagcgctgaccagagccctccggagactacagccagggagtgtggctccagggaatggggaggaggtcatcagctttgctactgtcacagactccacttcagcctacagctccctgctcacttttcacctgtccactcctcggtcccaccacctgtaccatgcccgcctgtggctgcacgtgctccccacccttcctggcactctttgcttgaggatcttccgatggggaccaaggaggaggcgccaagggtcccgcactctcctggctgagcaccacatcaccaacctgggctggcataccttaactctgccctctagtggcttgaggggtgagaagtctggtgtcctgaaactgcaactagactgcagacccctagaaggcaacagcacagttactggacaaccgaggcggctcttggacacagcaggacaccagcagcccttcctagagcttaagatccgagccaatgagcctggagcaggccgggccaggaggaggacccccacctgtgagcctgcgacccccttatgttgcaggcgagaccattacgtagacttccaggaactgggatggcgggactggatactgcagcccgaggggtaccagctgaattactgcagtgggcagtgccctccccacctggctggcagcccaggcattgctgcctctttccattctgccgtcttcagcctcctcaaagccaacaatccttggcctgccagtacctcctgttgtgtccctactgcccgaaggcccctctctctcctctacctggatcataatggcaatgtggtcaagacggatgtgccagatatggtggtggaggcctgtggctgcagctagcaagaggacctggggctttggagtgaagagaccaagatgaagtttcccaggcacagggcatctgtgactggaggcatcagattcctgatccacaccccaacccaacaaccacctggcaatatgactcacttgacccctatgggacccaaatgggcactttcttgtctgagactctggcttattccaggttggctgatgtgttgggagatgggtaaagcgtttcttctaaaggggtctacccagaaagcatgatttcctgccctaagtcctgtgagaagatgtcagggactagggagggagggagggaaggcagagaaaaattacttagcctctcccaagatgagaaagtcctcaagtgaggggaggaggaagcagatagatggtccagcaggcttgaagcagggtaagcaggctggcccagggtaagggctgttgaggtaccttaagggaaggtcaagagggagatgggcaaggcgctgagggaggatgcttaggggacccccagaaacaggagtcaggaaaatgaggcactaagcctaagaagttccctggtttttcccaggggacaggacccactgggagacaagcatttatactttctttcttcttttttatttttttgagatcgagtctcgctctgtcaccaggctggagtgcagtgacacgatcttggctcactgcaacctccgtctcctgggttcaagtgattcttctgcctcagcctcccgagcagctgggattacaggcgcccactaatttttgtattcttagtagaaacgaggtttcaacatgttggccaggatggtctcaatctcttgacctcttgatccacccgacttggcctcccgaagtgatgagattataggcgtgagccaccgcgcctggcttatactttcttaataaaaaggagaaagaaaatcaacaaatgtgagtcataaagaagggttagggtgatggtccagagcaacagttcttcaagtgtactctgtaggcttctgggaggtcccttttcaggggtgtccacaaagtcaaagctattttcataataatactaacatgttatttgccttttgaattctcattatcttaaaattgtattgtggagttttccagaggccgtgtgacatgtgattacatcatctttctgacatcattgttaatggaatgtgtgc

SEQ ID NO: 290140 - DNA, 450 bp, Homo sapiens
gcggacgcgagtagctcggcagggggactcgcttggctttcgtgccatccgtggacacagtcgcgcgggtctttgtgggaagaaacaaatcacaaaagcaattaagagagctcaaacaatggggtttatgccagttacatacaaggatcctgcatatttcagggaccctaaagtttataacatcagatatccggaataaattccatcacattaccaccagtaaacttattttataagatgggtctcactgtgttgcccaggctggtctctaactcctggcctcaatcattcctgccttgtcttccctaagtgctgggattacagctgtgagccactgtgcctggcctcacttttccaattctaaagaatgtgtgtaagcctttccctcaacaacttattgaaaggcgaaaaaaggtttggaaataaaaggatctgatgtttgaaaaagta

SEQ ID NO: 290141 - DNA, 826 bp, Homo sapiens
cccgcaggtggccgccacgctcaacaacttggctgtcctctatgggaagcgtgggcgttaccgggaggcagagcccctgtgccagcgcgctttggagatccgagagaaggtcctgggtgctgaccacccagatgtggccaagcagctcaacaacctggccctgctgtgccagaaccagggcaagtttgaggacgtggagcggcactatgcccgggccctgagcatctatgaggcactgggcgggccccatgaccccaacgtggccaagaccaagaacaacctggcctcagcctacctgaaacagaacaagtatcaacaagcggaagagctgtacaaagaaatcctccacaaggaggacctacccgcccctctcggtgcccccaacacaggcacagctggtgacgcagaacaggcccttcgccgcagcagctcactctccaagatccgtgagtctatcaggcgaggaagtgagaagctggtctcccggctccgaggcgaggcggcggcaggagcagccggaatgaagagagccatgtcactcaacacactgaacgtggatgctccaagggctcctgggactcagtttcccagctggcacctggacaaggcccctcggaccctcagcgccagcacccaggacctgagcccccactaacgtccagtgaactgcgctggccgcagcttcttgggaacagtgcaggagggatgggctggtggggtgagagggggtctatcatctcctggcccccccttgcctctgggtacctggtggatagctgccttctcctgcgattaaaggctgtggacgtgacagtgagaaatgtca

SEQ ID NO: 290142 - DNA, 532 bp, Homo sapiens
gaggtaagaatttaatgttttaataagtatttttgcaaagaacatattttaataggtaataatttgtagccaattacattttaaggaaaatatattaaatttctaaaattattcctcatagcagttacacctgtctgtaatacatttataaaaatgttctgcaaaatggacttcttaaaaaagatgtactttattttgggattaaaaaccatcaagttgcaccagaaattcatgaaaatactttgtcatttcctctactgtactaataatctatatactacttacagaaagcgtgcataagataaattgaaggttttgttagtgactcattatataacctatgtagcacttcattacatcttggtttgttcttgaaggtttttttgcgaggggagaattatgagataacctcaactaaaacaaaaaaatctttttaggattattaaagtttcagtataaattcataatacactattaagacagtaagtggaatctcacacacatattctctcattttaatggtaaagcaact

SEQ ID NO: 290143 - DNA, 497 bp, Homo sapiens
ctttcctattctttattcctctttcaacttcattaatcttcagaagaaagaggaataaagaataggaaagtaataacagaatcattattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttat

SEQ ID NO: 290144 - DNA, 314 bp, Homo sapiens
aattactttaatatgctgttgaacctgagtaatttagttaaccctgagtaattactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttat

SEQ ID NO: 290145 - DNA, 4832 bp, Homo sapiens
gggcactttaaaggaagaaaagatatgtttctcattctaaaatatgcattataatttagcagtcccattgtttaaaatccaatgtgaaaagactgttatggaatgaaaagttgcacaactcctggagcagttaaagtccgctacatgcaacataggctacaaagcactcaagactagttctctctctctcgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaatatacaaatctatttacagcacaatttaatataccagatttataaggtggaaattcatgtgcagagacatttaacttaatgccatgtacttgattattttgttctttaaagaagagattattaaagaacatgttggttgaatgtttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaataatggaattgattattttcctttttggccatcacgtacacatgtaatctggaaaatcatacctttgtcaattttaaacataacttttggcatttcccagatttatactatgaacattggggtaatacattttattttttcattgctatatgacagctaaggggcaaatgattcaagtatattttaaatcagaagtattcaagttatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttatttggtttgccttaagcattacttttttaactttgtgccatttggtctttactttttatggatgttttcaaggaaactattttatattcaatctagtttatttagtctactgtatttctatttcgtggaagccttttcccctcaaataatatattatatcatttttggacttatataaatgataattaaataaatttttttcttaatactgttggactttgtatatacaagttcaaataactttttcgaagatagtttcttatataaatgtaatttaatttttttactcttctatacagttctttagatgtaaaagaattagcacaatctctggcagttttataaaagctgttgaagctcttgtcctgcactgtctttaggtatcataggtatcaggtttgctttgtgttaatgccacttcaagtcattatttggtttctgctatttttttacctgaggataagaagaatgaatattaaatttgaatattaaatatatgttactttccaagcactgtataatgactgttcagtgaatatcagacttccgtgtcattaaaagtcatgagagacagcacagagaggttataggttgccttggtgtacttttgtccaggagtaacagggacagaatactttctttccttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaatcttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttatgggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttat

SEQ ID NO: 290146 - DNA, 4778 bp, Homo sapiens
gggcactttaaaggaagaaaagatatgtttctcattctaaaatatgcattataatttagcagtcccattgtttaaaatccaatgtgaaaagactgttatggaatgaaaagttgcacaactcctggagcagttaaagtccgctacatgcaacataggctacaaagcactcaagactagttctctctctctcgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaatatacaaatctatttacagcacaatttaatataccagatttataaggtggaaattcatgtgcagagacatttaacttaatgccatgtacttgattattttgttctttaaagaagagattattaaagaacatgttggttgaatgtttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaataatggaattgattattttcctttttggccatcacgtacacatgtaatctggaatatgaacattggggtaatacattttattttttcattgctatatgacagctaaggggcaaatgattcaagtatattttaaatcagaagtattcaagttatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttatttggtttgccttaagcattacttttttaactttgtgccatttggtctttactttttatggatgttttcaaggaaactattttatattcaatctagtttatttagtctactgtatttctatttcgtggaagccttttcccctcaaataatatattatatcatttttggacttatataaatgataattaaataaatttttttcttaatactgttggactttgtatatacaagttcaaataactttttcgaagatagtttcttatataaatgtaatttaatttttttactcttctatacagttctttagatgtaaaagaattagcacaatctctggcagttttataaaagctgttgaagctcttgtcctgcactgtctttaggtatcataggtatcaggtttgctttgtgttaatgccacttcaagtcattatttggtttctgctatttttttacctgaggataagaagaatgaatattaaatttgaatattaaatatatgttactttccaagcactgtataatgactgttcagtgaatatcagacttccgtgtcattaaaagtcatgagagacagcacagagaggttataggttgccttggtgtacttttgtccaggagtaacagggacagaatactttctttccttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaatcttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttatgggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttat

SEQ ID NO: 290147 - DNA, 4713 bp, Homo sapiens
gggcactttaaaggaagaaaagatatgtttctcattctaaaatatgcattataatttagcagtcccattgtttaaaatccaatgtgaaaagactgttatggaatgaaaagttgcacaactcctggagcagttaaagtccgctacatgcaacataggctacaaagcactcaagactagttctctctctctcgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaatatacaaatctatttacagcacaatttaatataccagatttataaggtggaaattcatgtgcagagacatttaacttaatgccatgtacttgattattttgttctttaaagaagagattattaaagaacatgttggttgaatgtttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaataatggaattgattattttcctttttggccatcacgtacacatgtaatctggaaaatcatacctttgtcaattttaaacataacttttggcatttcccagatttatactatgaacattggggtaatacattttattttttcattgctatatgacagctaaggggcaaatgattcaagtatattttaaatcagaagtattcaagttatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttatttggtttgccttaagcattacttttttaactttgtgccatttggtctttactttttatggatgttttcaaggaaactattttatattcaatctagtttatttagtctactgtatttctatttcgtggaagccttttcccctcaaataatatattatatcatttttggacttatataaatgataattaaataaatttttttcttaatactgttggactttgtatatacaagttcaaataactttttcgaagatagtttcttatataaatgtaatttaatttttttactcttctatacagttctttagatgtaaaagaattagcacaatctctggcagttttataaaagctgttgaagctcttgtcctgcactgtctttaggtatcataggtatcaggtttgctttgtgttaatgccacttcaagtcattatttggtttctgctatttttttacctgaggataagaagaatgaatattaaatttgaatattaaatatatgttactttccaagcactgtataatgactgttcagtgaatatcagacttccgtgtcattaaaagtcatgagagacagcacagagaggttataggttgccttggtgtacttttgtccaggagtaacagggacagaatactttctttccttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaatcttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttatgggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggtactacgctttggcaggtaccgag

SEQ ID NO: 290148 - DNA, 3502 bp, Homo sapiens
tgaaactcgtaattctgttgcagatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaatatacaaatctatttacagcacaatttaatataccagatttataaggtggaaattcatgtgcagagacatttaacttaatgccatgtacttgattattttgttctttaaagaagagattattaaagaacatgttggttgaatgtttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaataatggaattgattattttcctttttggccatcacgtacacatgtaatctggaaaatcatacctttgtcaattttaaacataacttttggcatttcccagatttatactatgaacattggggtaatacattttattttttcattgctatatgacagctaaggggcaaatgattcaagtatattttaaatcagaagtattcaagttatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttatttggtttgccttaagcattacttttttaactttgtgccatttggtctttactttttatggatgttttcaaggaaactattttatattcaatctagtttatttagtctactgtatttctatttcgtggaagccttttcccctcaaataatatattatatcatttttggacttatataaatgataattaaataaatttttttcttaatactgttggactttgtatatacaagttcaaataactttttcgaagatagtttcttatataaatgtaatttaatttttttactcttctatacagttctttagatgtaaaagaattagcacaatctctggcagttttataaaagctgttgaagctcttgtcctgcactgtctttaggtatcataggtatcaggtttgctttgtgttaatgccacttcaagtcattatttggtttctgctatttttttacctgaggataagaagaatgaatattaaatttgaatattaaatatatgttactttccaagcactgtataatgactgttcagtgaatatcagacttccgtgtcattaaaagtcatgagagacagcacagagaggttataggttgccttggtgtacttttgtccaggagtaacagggacagaatactttctttccttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaatcttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttatgggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttat

SEQ ID NO: 290149 - DNA, 3820 bp, Homo sapiens
ttgatacatattaacatgtgaatcacatttccagagagaatttccataattgagcaattcttttctgaatggatttaagccttaattttcagttttcctctttctggttgaaattttactactataaaagataactttagcactgattttagtaccaatcttattattaacctgaagtgacacttaatttagaactagaactcaaaccttccgactgttagcctcgttaatggggatattttttaaaaaatagatgtgtgtaatgttacattgattgtgttctagccttgtaagttgatatagttggcagcctagctgtatttctcagagtttgtcataatctatatttaaaataacatgaaacactttgaaatgtcacttatagctagttccaatgatatttttaaatgtattataagtaatatcaatttcatctttccacaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaatatacaaatctatttacagcacaatttaatataccagatttataaggtggaaattcatgtgcagagacatttaacttaatgccatgtacttgattattttgttctttaaagaagagattattaaagaacatgttggttgaatgtttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaataatggaattgattattttcctttttggccatcacgtacacatgtaatctggaaaatcatacctttgtcaattttaaacataacttttggcatttcccagatttatactatgaacattggggtaatacattttattttttcattgctatatgacagctaaggggcaaatgattcaagtatattttaaatcagaagtattcaagttatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttatttggtttgccttaagcattacttttttaactttgtgccatttggtctttactttttatggatgttttcaaggaaactattttatattcaatctagtttatttagtctactgtatttctatttcgtggaagccttttcccctcaaataatatattatatcatttttggacttatataaatgataattaaataaatttttttcttaatactgttggactttgtatatacaagttcaaataactttttcgaagatagtttcttatataaatgtaatttaatttttttactcttctatacagttctttagatgtaaaagaattagcacaatctctggcagttttataaaagctgttgaagctcttgtcctgcactgtctttaggtatcataggtatcaggtttgctttgtgttaatgccacttcaagtcattatttggtttctgctatttttttacctgaggataagaagaatgaatattaaatttgaatattaaatatatgttactttccaagcactgtataatgactgttcagtgaatatcagacttccgtgtcattaaaagtcatgagagacagcacagagaggttataggttgccttggtgtacttttgtccaggagtaacagggacagaatactttctttccttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaatcttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttatgggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttat

SEQ ID NO: 290150 - DNA, 414 bp, Homo sapiens
gtatactaaatatgtaacttacacttcacaagccagatatgtgatttctggcttgtgatatgtaatgtcagttttgagtcctgacattagtgctaagtagatacgttaccttgggcaaaactttgttggcctcagttttctcaagcatataaaaaagataatgatctatatcttgcatggttttatgaaactggtaataattatgtatattagatgttagcacctggtatggtagtaattatgagaatttcattattttaatttgaaagttaaattttcctctggtctttttagaatctggaggtgaactggatattgtagtgacctcaaataaagaagtaaaagttgctgctgtccgagatgccttccaggaggtctttggcttagctgtggttgtaggggaagctggacagt

SEQ ID NO: 290151 - DNA, 4667 bp, Homo sapiens
gtggccatcttgtaggcggggacacgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaatatacaaatctatttacagcacaatttaatataccagatttataaggtggaaattcatgtgcagagacatttaacttaatgccatgtacttgattattttgttctttaaagaagagattattaaagaacatgttggttgaatgtttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaataatggaattgattattttcctttttggccatcacgtacacatgtaatctggaaaatcatacctttgtcaattttaaacataacttttggcatttcccagatttatactatgaacattggggtaatacattttattttttcattgctatatgacagctaaggggcaaatgattcaagtatattttaaatcagaagtattcaagttatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttatttggtttgccttaagcattacttttttaactttgtgccatttggtctttactttttatggatgttttcaaggaaactattttatattcaatctagtttatttagtctactgtatttctatttcgtggaagccttttcccctcaaataatatattatatcatttttggacttatataaatgataattaaataaatttttttcttaatactgttggactttgtatatacaagttcaaataactttttcgaagatagtttcttatataaatgtaatttaatttttttactcttctatacagttctttagatgtaaaagaattagcacaatctctggcagttttataaaagctgttgaagctcttgtcctgcactgtctttaggtatcataggtatcaggtttgctttgtgttaatgccacttcaagtcattatttggtttctgctatttttttacctgaggataagaagaatgaatattaaatttgaatattaaatatatgttactttccaagcactgtataatgactgttcagtgaatatcagacttccgtgtcattaaaagtcatgagagacagcacagagaggttataggttgccttggtgtacttttgtccaggagtaacagggacagaatactttctttccttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaatcttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttatgggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttat

SEQ ID NO: 290152 - DNA, 4908 bp, Homo sapiens
gggcactttaaaggaagaaaagatatgtttctcattctaaaatatgcattataatttagcagtcccattgtttaaaatccaatgtgaaaagactgttatggaatgaaaagttgcacaactcctggagcagttaaagtccgctacatgcaacataggctacaaagcactcaagactagttctctctctctcgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaatatacaaatctatttacagcacaatttaatataccagatttataaggtggaaattcatgtgcagagacatttaacttaatgccatgtacttgattattttgttctttaaagaagagattattaaagaacatgttggttgaatgtttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaataatggaattgattattttcctttttggccatcacgtacacatgtaatctggaaaatcatacctttgtcaattttaaacataacttttggcatttcccagatttatactatgaacattggggtaatacattttattttttcattgctatatgacagctaaggggcaaatgattcaagtatattttaaatcagaagtattcaagttatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttatttggtttgccttaagcattacttttttaactttgtgccatttggtctttactttttatggatgttttcaaggaaactattttatattcaatctagtttatttagtctactgtatttctatttcgtggaagccttttcccctcaaataatatattatatcatttttggacttatataaatgataattaaataaatttttttcttaatactgttggactttgtatatacaagttcaaataactttttcgaagatagtttcttatataaatgtaatttaatttttttactcttctatacagttctttagatgtaaaagaattagcacaatctctggcagttttataaaagctgttgaagctcttgtcctgcactgtctttaggtatcataggtatcaggtttgctttgtgttaatgccacttcaagtcattatttggtttctgctatttttttacctgaggataagaagaatgaatattaaatttgaatattaaatatatgttactttccaagcactgtataatgactgttcagtgaatatcagacttccgtgtcattaaaagtcatgagagacagcacagagaggttataggttgccttggtgtacttttgtccaggagtaacagggacagaatactttctttccttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaatcttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttatgggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttataaaaaaaacaccacaccaaaaacacttttgcgcccctctgccccgaaaactttttaaccattttgggcgccgccca

SEQ ID NO: 290153 - DNA, 371 bp, Homo sapiens
aagcagatgaagcttcgagtgatgaattcccaggagcagtgcctcccttcaggagccgaggacatcatgtctggtggccccactttggaggctgctgaatttgatgacttgattgggaagtgtctgccagatcgccccattgcagagtgaggatggacagttcccgcgtttggaaacacatttcctggatgaacttaagagctgtggccactagttcgttctaaaaatcattattgggcaccagcatgtgtggataaataaagcctcccacctgccccacatcaccaaggatgagaagatccagtaaactggggagagtgaattggtttgaaaacacatttgatttcaggaataaaaggtgcaaatgagta

SEQ ID NO: 290154 - DNA, 340 bp, Homo sapiens
gtggtccagtacagctgagaggccaagccagagaccctctgcctacagctggggccgaggagggaggaagaaccctaaaataccaagaagataactcataaaaagtaaaggattttttctgccttctgggggatctgagtagctccagaggacaaactcagaataaaggggcttctgtgtgtacctttcctgccttcctgtaggtggtggaggcacggagggcttcccacaagaagcacagaggagggcagacacttagcatggggaccacctttgtctttcgagtggatgcgtgctttaacttcactcttattctgcttttcagggttcagctttgggt

SEQ ID NO: 290155 - DNA, 350 bp, Homo sapiens
cccttgagttgcacaagaaggaaacattgcatagaatgaaaaatgacagcaaactgctgaggtcacttccccaggcccactgaatgagaatatcagttcctgtgctggagagaaaggcagtcagaggagaaaatgaggtccagctcgtccctggctcccaaagtgctgggattacaggtgtgagccaccgtgcccggcgcattgctgtcttcatatggtatactagctatttctggccatgagaggaaggttatagttcaggctccagggagcagtgtcagggcccgggagacgatggtctcctgtgactatggctacttccgtgtggatccagttctttaagtaatctg

SEQ ID NO: 290156 - DNA, 3245 bp, Homo sapiens
cccttgagttgcacaagaaggaaacattgcatagaatgaaaaatgacagcaaactgctgaggtcacttccccaggcccactgaatgagaatatcagttcctgtgctggagagaaaggcagtcagaggagaaaatgaggtccagctcgtccctggctctctctctctctcaggtcctgatgtcttttccaagtctggagagcagcgatgctgctgtgccctgcgcagaaaaccgtgttccggctgcagctaaccaccgcagctcaatgtctctgggtgtatctcagagataagcaggtggtggtgttccttgcttatcccacaagggcacctggccggaataatggagtcacttccctccactggcctgaccccactctttctctttcctggacacaggaggcatacacggaatacctgaggagcatccactatatctcccaggtgttactagaagaagtggaaaccactaaagaagctggggaaactgtgccccccgacacctccaagatgctgaaactagcacagcagtgtctggagagggcccagtcgacggccgccaagcttgggaaaacacgcctgaagccaaccatgcctgcagctgctcccatcccccagcctgccggccgacaccgccgtgtatactccgatgaaggaggaaagctctctccttttctgccacccgagatcttccagaagcttcagggggcagagtcacaaagctgtaagaaagagctgacgccactggaggaggcctccctgcagaatcagaagctgaaggctgcgtatgaggcccgaatggcgcggctagaccccagccaggccatgcagaagacatccctgaccctctctctacagcggcagatgatggagaacctagtgattgccaaagcccgggaggagacactccagagaaagatggaggagcgccggctgcggctccaggaggccgccaacaggaggttttgcagccaagtcgccctgaccccggaggaacgggagcagcgggccctttacgccgccatcctggagtacgaacaggaccatgactggccgaagcactggaaggccaagctcaagaggaatccgggggacctgtcactcgtgaccagcctggtctcacacctgctcagcctccccgaccacccgatcgcgcagctcctgaggcggctgcagtgctccgtgtacagcgccctgtatcccgccgtgagcagagcagccgcgccagccccaggctgctgccccccgacccccaaccccggaagccgacggctgcggccctcgcagagcctccattgcatgctgtccccgcccgagcccagcgcagccccgcggccccaggacagtccccccacgcccccactccaacccggcccgtggggtctccctcacccctgggggacaccgcatctggattgccagacaaggacagctcgttcgaggacctggagcagttcctggggacgtctgagccgcagggccggggccgtggggtacagccggagccccagctgcagcagctgaagaccgcggtggaggagatccacaatgccgtagacaggctgctctcgctgacccttctggccttcgaaggcctaaacacagctgcctccaaggaccgctgcctggcctgcattgaggaaccctttttctccccgctgtggcctctgctgctggccctgtacaggagcgtgcaccgagcccgggaggctgccctgagcaggagcatggagctctacaggaatgcaccccccaccgccattggcatccccaccaagctcctcccccagaaccctgaggccaagggggccactggctacccctactgcgcggcggcccaggagctcggactgctggtcctggagagctgcccccagaagaagctggagtgcatagtgcggaccctgcggatcatctgtgtctgtgcggaagactactgccccaccccagaggccacaccccaggccggcccccgcccatcgctgcagctgccattggtgccgatgacctgctgcccatcctgtccttcgtggtgctgaggagcggcctccctcagctggtgtcggagtgcgcggccctggaggagttcatccacgaggggtacctgatcggagaggagggctactgcctcacatcactgcagagtgccctgagctacgtggagctgctgccccggggaggcctggccaagtagtacagctagagcccagggtccctgcagggcctggcctcgcctcccagggctgtctctcctacacctggagccatgggatctactgaggaccatcctggagcctcacgctgctctgcacatggtgggggcttgtccactgtggtgtgctctccagctcttcaccttcctcacctcacatctgaccctggagcttggggttggcacctctgccccgacagaatggggctgaatcagctccaggaggaaccaggccctgctctcctgtgtaggcctcagagaggccaagaagggaagctttgggcttcggtgggtgcaggctcagcgatgaacatctggctggggcagctcctggggagcatcagggaagagggggccatgagccggccagcagtggagacggcagtccagtttctctcccctctgacccctagaaggggagttgtagccccatgaactagtttcttgtctgggtcaggaacaagggccggctggggcctggggtgcagctggtgtcagggtatgctgtttgctgatgggcagggacacccctgcagggtctcgggctctgagcccaggacattccctgccccttgctcaccttggctgtgggctgtgaacattccgggaccctgggcatcttatctaggtccgtgcagcccaagggtcagccctcttgactgtcacatgctgcccccacccagcctaaaataaagagctcactgctgtgaaaaaaaaaaaaaaaaaaaaaaaaaaagaaaaaaaaaaaaaaaaaaaaaaaaaaaaaaaaaaaaaaaaaaaaaaggggggggggggcccaaaaatcccccctggggggggggcccactgttgtgcggccccgcccgagttttttgtaaagagggggtccccatgatgtggcggctgctttattaatagacacgcggtcctgcggcggtgttttaaacacgctgtgtccgctggacgcacacgggtccggctgcgtggcgtccctgtgtgagggagaccccctcttgcgtggggggcgcccacattgcgtgggacgcctctccgcag

SEQ ID NO: 290157 - DNA, 3072 bp, Homo sapiens
gcggccgcgtcccttcctgcggtccgctgctcgggcggctccagcaccagcgccggctgcgttccgggcctccggtcgcccgtccagcccctcggctaccgccgccgcctcccccgctcggcgccatggccgctgcggccggggacggcacggtgaagccgctgcagagcgccatgaagcttgccaacggggccatcgagctggacaccggcaaccggccccgggaggcatacacggaatacctgaggagcatccactatatctcccaggtgttactagaagaagtggaaaccactaaagaagctggggaaactgtgccccccgacacctccaagatgctgaaactagcacagcagtgtctggagagggcccagtcgacggccgccaagcttgggaaaacacgcctgaagccaaccatgcctgcagctgctcccatcccccagcctgccggccgacaccgccgtgtatactccgatgaaggaggaaagctctctccttttctgccacccgagatcttccagaagcttcagggggcagagtcacaaagctgtaagaaagagctgacgccactggaggaggcctccctgcagaatcagaagctgaaggctgcgtatgaggcccgaatggcgcggctagaccccagccaggccatgcagaagacatccctgaccctctctctacagcggcagatgatggagaacctagtgattgccaaagcccgggaggagacactccagagaaagatggaggagcgccggctgcggctccaggaggccgccaacaggaggttttgcagccaagtcgccctgaccccggaggaacgggagcagcgggccctttacgccgccatcctggagtacgaacaggaccatgactggccgaagcactggaaggccaagctcaagaggaatccgggggacctgtcactcgtgaccagcctggtctcacacctgctcagcctccccgaccacccgatcgcgcagctcctgaggcggctgcagtgctccgtgtacagcgccctgtatcccgccgtgagcagagcagccgcgccagccccaggctgctgccccccgacccccaaccccggaagccgacggctgcggccctcgcagagcctccattgcatgctgtccccgcccgagcccagcgcagccccgcggccccaggacagtccccccacgcccccactccaacccggcccgtggggtctccctcacccctgggggacaccgcatctggattgccagacaaggacagctcgttcgaggacctggagcagttcctggggacgtctgagccgcagggccggggccgtggggtacagccggagccccagctgcagcagctgaagaccgcggtggaggagatccacaatgccgtagacaggctgctctcgctgacccttctggccttcgaaggcctaaacacagctgcctccaaggaccgctgcctggcctgcattgaggaaccctttttctccccgctgtggcctctgctgctggccctgtacaggagcgtgcaccgagcccgggaggctgccctgagcaggagcatggagctctacaggaatgcaccccccaccgccattggcatccccaccaagctcctcccccagaaccctgaggccaagggggccactggctacccctactgcgcggcggcccaggagctcggactgctggtcctggagagctgcccccagaagaagctggagtgcatagtgcggaccctgcggatcatctgtgtctgtgcggaagactactgccccaccccagaggccacaccccaggccggcccccgcccatcgctgcagctgccattggtgccgatgacctgctgcccatcctgtccttcgtggtgctgaggagcggcctccctcagctggtgtcggagtgcgcggccctggaggagttcatccacgaggggtacctgatcggagaggagggctactgcctcacatcactgcagagtgccctgagctacgtggagctgctgccccggggaggcctggccaagtagtacagctagagcccagggtccctgcagggcctggcctcgcctcccagggctgtctctcctacacctggagccatgggatctactgaggaccatcctggagcctcacgctgctctgcacatggtgggggcttgtccactgtggtgtgctctccagctcttcaccttcctcacctcacatctgaccctggagcttggggttggcacctctgccccgacagaatggggctgaatcagctccaggaggaaccaggccctgctctcctgtgtaggcctcagagaggccaagaagggaagctttgggcttcggtgggtgcaggctcagcgatgaacatctggctggggcagctcctggggagcatcagggaagagggggccatgagccggccagcagtggagacggcagtccagtttctctcccctctgacccctagaaggggagttgtagccccatgaactagtttcttgtctgggtcaggaacaagggccggctggggcctggggtgcagctggtgtcagggtatgctgtttgctgatgggcagggacacccctgcagggtctcgggctctgagcccaggacattccctgccccttgctcaccttggctgtgggctgtgaacattccgggaccctgggcatcttatctaggtccgtgcagcccaagggtcagccctcttgactgtcacatgctgcccccacccagcctaaaataaagagctcactgctgtgaaaaaaaaaaaaaaaaaaaaaaaaaaagaaaaaaaaaaaaaaaaaaaaaaaaaaaaaaaaaaaaaaaaaaaaaaggggggggggggcccaaaaatcccccctggggggggggcccactgttgtgcggccccgcccgagttttttgtaaagagggggtccccatgatgtggcggctgctttattaatagacacgcggtcctgcggcggtgttttaaacacgctgtgtccgctggacgcacacgggtccggctgcgtggcgtccctgtgtgagggagaccccctcttgcgtggggggcgcccacattgcgtgggacgcctctccgcag

SEQ ID NO: 290158 - DNA, 3544 bp, Homo sapiens
gtggtgtggtgtggttgcgctgtggcttgtcgcgtggctggcgacttcgttgttgtttgtgctctgtgggcgtggtggtgcagctgctgcgcgtgggtcgtgcgtcttgttgctcgtggtgctgtgcttcggtggcgtcgtctgtctgtctgacggtgtctccgtcggtcgcggcgcgtggctgcggttcgttgggtcgctctccggccccttctgccgtctctcgcgccctggtgctgtctccgggagtggtccgcagtggtgtcggtgtgggtggctttgggggtggtgtcctgtgcctcccgcctgctgtggatgatgtggtcgtcagcgtggggctgtccccccggggcgctgctcgtgccgcccctcgccgccgccccgctttcccgcctccggtcagcgcgctgccgcgggggcagtgggcttgcctgccttttccgttgcctcattttatctcagcagtaagtaacagtggtagagccgactgtgaccagccttcttgtccctcccccagaagctggggaaactgtgccccccgacacctccaagatgctgaaactagcacagcagtgtctggagagggcccagtcgacggccgccaagcttggtgggtctcctgcagtaggcggctctcctggggcatcccccaagcccgcatctcctctgtgggatgtggcccaccgcttgacccctggttacccatggctggaaaacacgcctgaagccaaccatgcctgcagctgctcccatcccccagcctgccggccgacaccgccgtgtatactccgatgaaggaggaaagctctctccttttctgccacccgagatcttccagaagcttcagggggcagagtcacaaagctgtaagaactcctggcctcagagcaatccgggaggatgagagagactcctctggtgtccagacaccactgggcttcctggggtctagacagcagcttgtcacatttccagagagctgacgccactggaggaggcctccctggggacagcccctcaccgagaggaggtccctgggacgtcccggcctctccgggtgtgggacggggttgggaaccgagggcccgctcagatcccacgctcggccccttgactctgcacccagctccagagaaagatggaggagcgccggctgcggctccaggaggccgccaacaggtgggactcctgcccgcccctggggccgctgcggggagggcctggccccggcacccaccgcgtgcctttctccccaggaggttttgcagccaagtcgccctgaccccggaggaacgggagcagcgggccctttacgccgccatcctggagtacgaacaggaccatgactggccgaagcactggaaggccaagctcaagaggaatccgggggacctgtcactcgtgaccagcctggtctcacacctgctcagcctccccgaccacccgatcgcgcagctcctgaggcggctgcagtgctccgtgtacagcgccctgtatcccgccgtgagcagagcagccgcgccagccccaggctgctgccccccgacccccaaccccggaagccgacggctgcggccctcgcagagcctccattgcatgctgtccccgcccgagcccagcgcagccccgcggccccaggacagtccccccacgcccccactccaacccggcccgtggggtctccctcacccctgggggacaccgcatctggattgccagacaaggacagctcgttcgaggacctggagcagttcctggggacgtctgagccgcagggccggggccgtggggtacagccggagccccagctgcagcagctgaagaccgcggtggaggagatccacaatgccgtagacaggctgctctcgctgacccttctggccttcgaaggcctaaacacagctgcctccaaggaccgctgcctggcctgcattgaggaaccctttttctccccgctgtggcctctgctgctggccctgtacaggagcgtgcaccgagcccgggaggctgccctgagcaggagcatggagctctacaggaatgcaccccccaccgccattggcatccccaccaagctcctcccccagaaccctgaggccaagggggccactggctacccctactgcgcggcggcccaggagctcggactgctggtcctggagagctgcccccagaagaagctggagtgcatagtgcggaccctgcggatcatctgtgtctgtgcggaagactactgccccaccccagaggccacaccccaggccggcccccgcccatcgctgcagctgccattggtgccgatgacctgctgcccatcctgtccttcgtggtgctgaggagcggcctccctcagctggtgtcggagtgcgcggccctggaggagttcatccacgaggggtacctgatcggagaggagggctactgcctcacatcactgcagagtgccctgagctacgtggagctgctgccccggggaggcctggccaagtagtacagctagagcccagggtccctgcagggcctggcctcgcctcccagggctgtctctcctacacctggagccatgggatctactgaggaccatcctggagcctcacgctgctctgcacatggtgggggcttgtccactgtggtgtgctctccagctcttcaccttcctcacctcacatctgaccctggagcttggggttggcacctctgccccgacagaatggggctgaatcagctccaggaggaaccaggccctgctctcctgtgtaggcctcagagaggccaagaagggaagctttgggcttcggtgggtgcaggctcagcgatgaacatctggctggggcagctcctggggagcatcagggaagagggggccatgagccggccagcagtggagacggcagtccagtttctctcccctctgacccctagaaggggagttgtagccccatgaactagtttcttgtctgggtcaggaacaagggccggctggggcctggggtgcagctggtgtcagggtatgctgtttgctgatgggcagggacacccctgcagggtctcgggctctgagcccaggacattccctgccccttgctcaccttggctgtgggctgtgaacattccgggaccctgggcatcttatctaggtccgtgcagcccaagggtcagccctcttgactgtcacatgctgcccccacccagcctaaaataaagagctcactgctgtgaaaaaaaaaaaaaaaaaaaaaaaaaaagaaaaaaaaaaaaaaaaaaaaaaaaaaaaaaaaaaaaaaaaaaaaaaggggggggggggcccaaaaatcccccctggggggggggcccactgttgtgcggccccgcccgagttttttgtaaagagggggtccccatgatgtggcggctgctttattaatagacacgcggtcctgcggcggtgttttaaacacgctgtgtccgctggacgcacacgggtccggctgcgtggcgtccctgtgtgagggagaccccctcttgcgtggggggcgcccacattgcgtgggacgcctctccgcag

SEQ ID NO: 290159 - DNA, 2982 bp, Homo sapiens
tttccggggggagtcgggggctaaatcggggcgggatgagaaaatgggagtctatgagaagttttctgtgaagggcagcagggaggtgggtcaggcgctggggcggtgggtccaggggcgagtcacagagaggcagctcccacggcgcgcagaagggctgtgtgagcaggtccatggtcgcgcagaggtgctccatgccaagctacgggaaggcaggactttggggacacagccggtgggagatgggtgaggcgatcccctcagcacgtccttgtctctgtaaaacggccacttcccagaggcggaaaacacgcctgaagccaaccatgcctgcagctgctcccatcccccagcctgccggccgacaccgccgtgtatactccgatgaaggaggaaagctctctccttttctgccacccgagatcttccagaagcttcagggggcagagtcacaaagctgtaagaaagagctgacgccactggaggaggcctccctgcagaatcagaagctgaaggctgcgtatgaggcccgaatggcgcggctagaccccagccaggccatgcagaagacatccctgaccctctctctacagcggcagatgatggagaacctagtgattgccaaagcccgggaggagacactccagagaaagatggaggagcgccggctgcggctccaggaggccgccaacaggaggttttgcagccaagtcgccctgaccccggaggaacgggagcagcgggccctttacgccgccatcctggagtacgaacaggaccatgactggccgaagcactggaaggccaagctcaagaggaatccgggggacctgtcactcgtgaccagcctggtctcacacctgctcagcctccccgaccacccgatcgcgcagctcctgaggcggctgcagtgctccgtgtacagcgccctgtatcccgccgtgagcagagcagccgcgccagccccaggctgctgccccccgacccccaaccccggaagccgacggctgcggccctcgcagagcctccattgcatgctgtccccgcccgagcccagcgcagccccgcggccccaggacagtccccccacgcccccactccaacccggcccgtggggtctccctcacccctgggggacaccgcatctggattgccagacaaggacagctcgttcgaggacctggagcagttcctggggacgtctgagccgcagggccggggccgtggggtacagccggagccccagctgcagcagctgaagaccgcggtggaggagatccacaatgccgtagacaggctgctctcgctgacccttctggccttcgaaggcctaaacacagctgcctccaaggaccgctgcctggcctgcattgaggaaccctttttctccccgctgtggcctctgctgctggccctgtacaggagcgtgcaccgagcccgggaggctgccctgagcaggagcatggagctctacaggaatgcaccccccaccgccattggcatccccaccaagctcctcccccagaaccctgaggccaagggggccactggctacccctactgcgcggcggcccaggagctcggactgctggtcctggagagctgcccccagaagaagctggagtgcatagtgcggaccctgcggatcatctgtgtctgtgcggaagactactgccccaccccagaggccacaccccaggccggcccccgcccatcgctgcagctgccattggtgccgatgacctgctgcccatcctgtccttcgtggtgctgaggagcggcctccctcagctggtgtcggagtgcgcggccctggaggagttcatccacgaggggtacctgatcggagaggagggctactgcctcacatcactgcagagtgccctgagctacgtggagctgctgccccggggaggcctggccaagtagtacagctagagcccagggtccctgcagggcctggcctcgcctcccagggctgtctctcctacacctggagccatgggatctactgaggaccatcctggagcctcacgctgctctgcacatggtgggggcttgtccactgtggtgtgctctccagctcttcaccttcctcacctcacatctgaccctggagcttggggttggcacctctgccccgacagaatggggctgaatcagctccaggaggaaccaggccctgctctcctgtgtaggcctcagagaggccaagaagggaagctttgggcttcggtgggtgcaggctcagcgatgaacatctggctggggcagctcctggggagcatcagggaagagggggccatgagccggccagcagtggagacggcagtccagtttctctcccctctgacccctagaaggggagttgtagccccatgaactagtttcttgtctgggtcaggaacaagggccggctggggcctggggtgcagctggtgtcagggtatgctgtttgctgatgggcagggacacccctgcagggtctcgggctctgagcccaggacattccctgccccttgctcaccttggctgtgggctgtgaacattccgggaccctgggcatcttatctaggtccgtgcagcccaagggtcagccctcttgactgtcacatgctgcccccacccagcctaaaataaagagctcactgctgtgaaaaaaaaaaaaaaaaaaaaaaaaaaagaaaaaaaaaaaaaaaaaaaaaaaaaaaaaaaaaaaaaaaaaaaaaaggggggggggggcccaaaaatcccccctggggggggggcccactgttgtgcggccccgcccgagttttttgtaaagagggggtccccatgatgtggcggctgctttattaatagacacgcggtcctgcggcggtgttttaaacacgctgtgtccgctggacgcacacgggtccggctgcgtggcgtccctgtgtgagggagaccccctcttgcgtggggggcgcccacattgcgtgggacgcctctccgcag

SEQ ID NO: 290160 - DNA, 336 bp, Homo sapiens
gcggccgcgtcccttcctgcggtccgctgctcgggcggctccagcaccagcgccggctgcgttccgggcctccggtcgcccgtccagcccctcggctaccgccgccgcctcccccgctcggcgccatggccgctgcggccggggacggcacggtgaagccgctgcagagcgccatgaagcttgccaacggggccatcgagctggacaccggcaaccggccccgggtgaggcggggcgggggcggggcttggccgctgagggtggcccctggagggacccccgcccggggagggcgaggacggggccggctcgggctggagacttgggagcgggcgc

SEQ ID NO: 290161 - DNA, 2840 bp, Homo sapiens
gctaatttttgtatttttagtagagacagagtttcaccatgttggccaggctggtctcgaactcctgacctcaggtgatccgcccggccttagcctcctaaagtgctggcattagaggcgggagccactgcacctggccaaaacctgtgttttggaagggcaggcaagaaggggcagatgttgcagcccaccccagatggctcccctcctctttctcctcacctcctggcctcagagcaatccgggaggatgagagagactcctctggtgtccagacaccactgggcttcctggggtctagacagcagcttgtcacatttccagagagctgacgccactggaggaggcctccctgcagaatcagaagctgaaggctgcgtatgaggcccgaatggcgcggctagaccccagccaggccatgcagaagacatccctgaccctctctctacagcggcagatgatggagaacctagtgattgccaaagcccgggaggagacactccagagaaagatggaggagcgccggctgcggctccaggaggccgccaacaggaggttttgcagccaagtcgccctgaccccggaggaacgggagcagcgggccctttacgccgccatcctggagtacgaacaggaccatgactggccgaagcactggaaggccaagctcaagaggaatccgggggacctgtcactcgtgaccagcctggtctcacacctgctcagcctccccgaccacccgatcgcgcagctcctgaggcggctgcagtgctccgtgtacagcgccctgtatcccgccgtgagcagagcagccgcgccagccccaggctgctgccccccgacccccaaccccggaagccgacggctgcggccctcgcagagcctccattgcatgctgtccccgcccgagcccagcgcagccccgcggccccaggacagtccccccacgcccccactccaacccggcccgtggggtctccctcacccctgggggacaccgcatctggattgccagacaaggacagctcgttcgaggacctggagcagttcctggggacgtctgagccgcagggccggggccgtggggtacagccggagccccagctgcagcagctgaagaccgcggtggaggagatccacaatgccgtagacaggctgctctcgctgacccttctggccttcgaaggcctaaacacagctgcctccaaggaccgctgcctggcctgcattgaggaaccctttttctccccgctgtggcctctgctgctggccctgtacaggagcgtgcaccgagcccgggaggctgccctgagcaggagcatggagctctacaggaatgcaccccccaccgccattggcatccccaccaagctcctcccccagaaccctgaggccaagggggccactggctacccctactgcgcggcggcccaggagctcggactgctggtcctggagagctgcccccagaagaagctggagtgcatagtgcggaccctgcggatcatctgtgtctgtgcggaagactactgccccaccccagaggccacaccccaggccggcccccgcccatcgctgcagctgccattggtgccgatgacctgctgcccatcctgtccttcgtggtgctgaggagcggcctccctcagctggtgtcggagtgcgcggccctggaggagttcatccacgaggggtacctgatcggagaggagggctactgcctcacatcactgcagagtgccctgagctacgtggagctgctgccccggggaggcctggccaagtagtacagctagagcccagggtccctgcagggcctggcctcgcctcccagggctgtctctcctacacctggagccatgggatctactgaggaccatcctggagcctcacgctgctctgcacatggtgggggcttgtccactgtggtgtgctctccagctcttcaccttcctcacctcacatctgaccctggagcttggggttggcacctctgccccgacagaatggggctgaatcagctccaggaggaaccaggccctgctctcctgtgtaggcctcagagaggccaagaagggaagctttgggcttcggtgggtgcaggctcagcgatgaacatctggctggggcagctcctggggagcatcagggaagagggggccatgagccggccagcagtggagacggcagtccagtttctctcccctctgacccctagaaggggagttgtagccccatgaactagtttcttgtctgggtcaggaacaagggccggctggggcctggggtgcagctggtgtcagggtatgctgtttgctgatgggcagggacacccctgcagggtctcgggctctgagcccaggacattccctgccccttgctcaccttggctgtgggctgtgaacattccgggaccctgggcatcttatctaggtccgtgcagcccaagggtcagccctcttgactgtcacatgctgcccccacccagcctaaaataaagagctcactgctgtgaaaaaaaaaaaaaaaaaaaaaaaaaaagaaaaaaaaaaaaaaaaaaaaaaaaaaaaaaaaaaaaaaaaaaaaaaggggggggggggcccaaaaatcccccctggggggggggcccactgttgtgcggccccgcccgagttttttgtaaagagggggtccccatgatgtggcggctgctttattaatagacacgcggtcctgcggcggtgttttaaacacgctgtgtccgctggacgcacacgggtccggctgcgtggcgtccctgtgtgagggagaccccctcttgcgtggggggcgcccacattgcgtgggacgcctctccgcag

SEQ ID NO: 290162 - DNA, 2740 bp, Homo sapiens
gcggccgcgtcccttcctgcggtccgctgctcgggcggctccagcaccagcgccggctgcgttccgggcctccggtcgcccgtccagcccctcggctaccgccgccgcctcccccgctcggcgccatggccgctgcggccggggacggcacggtgaagccgctgcagagcgccatgaagcttgccaacggggccatcgagctggacaccggcaaccggccccggagagctgacgccactggaggaggcctccctgcagaatcagaagctgaaggctgcgtatgaggcccgaatggcgcggctagaccccagccaggccatgcagaagacatccctgaccctctctctacagcggcagatgatggagaacctagtgattgccaaagcccgggaggagacactccagagaaagatggaggagcgccggctgcggctccaggaggccgccaacaggaggttttgcagccaagtcgccctgaccccggaggaacgggagcagcgggccctttacgccgccatcctggagtacgaacaggaccatgactggccgaagcactggaaggccaagctcaagaggaatccgggggacctgtcactcgtgaccagcctggtctcacacctgctcagcctccccgaccacccgatcgcgcagctcctgaggcggctgcagtgctccgtgtacagcgccctgtatcccgccgtgagcagagcagccgcgccagccccaggctgctgccccccgacccccaaccccggaagccgacggctgcggccctcgcagagcctccattgcatgctgtccccgcccgagcccagcgcagccccgcggccccaggacagtccccccacgcccccactccaacccggcccgtggggtctccctcacccctgggggacaccgcatctggattgccagacaaggacagctcgttcgaggacctggagcagttcctggggacgtctgagccgcagggccggggccgtggggtacagccggagccccagctgcagcagctgaagaccgcggtggaggagatccacaatgccgtagacaggctgctctcgctgacccttctggccttcgaaggcctaaacacagctgcctccaaggaccgctgcctggcctgcattgaggaaccctttttctccccgctgtggcctctgctgctggccctgtacaggagcgtgcaccgagcccgggaggctgccctgagcaggagcatggagctctacaggaatgcaccccccaccgccattggcatccccaccaagctcctcccccagaaccctgaggccaagggggccactggctacccctactgcgcggcggcccaggagctcggactgctggtcctggagagctgcccccagaagaagctggagtgcatagtgcggaccctgcggatcatctgtgtctgtgcggaagactactgccccaccccagaggccacaccccaggccggcccccgcccatcgctgcagctgccattggtgccgatgacctgctgcccatcctgtccttcgtggtgctgaggagcggcctccctcagctggtgtcggagtgcgcggccctggaggagttcatccacgaggggtacctgatcggagaggagggctactgcctcacatcactgcagagtgccctgagctacgtggagctgctgccccggggaggcctggccaagtagtacagctagagcccagggtccctgcagggcctggcctcgcctcccagggctgtctctcctacacctggagccatgggatctactgaggaccatcctggagcctcacgctgctctgcacatggtgggggcttgtccactgtggtgtgctctccagctcttcaccttcctcacctcacatctgaccctggagcttggggttggcacctctgccccgacagaatggggctgaatcagctccaggaggaaccaggccctgctctcctgtgtaggcctcagagaggccaagaagggaagctttgggcttcggtgggtgcaggctcagcgatgaacatctggctggggcagctcctggggagcatcagggaagagggggccatgagccggccagcagtggagacggcagtccagtttctctcccctctgacccctagaaggggagttgtagccccatgaactagtttcttgtctgggtcaggaacaagggccggctggggcctggggtgcagctggtgtcagggtatgctgtttgctgatgggcagggacacccctgcagggtctcgggctctgagcccaggacattccctgccccttgctcaccttggctgtgggctgtgaacattccgggaccctgggcatcttatctaggtccgtgcagcccaagggtcagccctcttgactgtcacatgctgcccccacccagcctaaaataaagagctcactgctgtgaaaaaaaaaaaaaaaaaaaaaaaaaaagaaaaaaaaaaaaaaaaaaaaaaaaaaaaaaaaaaaaaaaaaaaaaaggggggggggggcccaaaaatcccccctggggggggggcccactgttgtgcggccccgcccgagttttttgtaaagagggggtccccatgatgtggcggctgctttattaatagacacgcggtcctgcggcggtgttttaaacacgctgtgtccgctggacgcacacgggtccggctgcgtggcgtccctgtgtgagggagaccccctcttgcgtggggggcgcccacattgcgtgggacgcctctccgcag

SEQ ID NO: 290163 - DNA, 818 bp, Homo sapiens
ctgtgggatccaagaacagaagaaataatgtcccaccaatcccagggcaacaagctgaggttagataaactccaggaccagggaccaaagaaacttcattaattgtcatttccaaagatctaaaatcggtcatagactggagcagaactggtacggtgaggccaaatcagtataacacccaaaaaacccacttcctgtgctatcgtgccaccctcttttcattttgttccccagaggcctagcaaaaaacagttaccaaaatgcctcttgaaagagtaggtaataacgtcctagaagtccaggtggtagctaacttcttgatttgtatatcccagaaggataccagggaaagtgaaaggagggaggcggcgggggcgaaacggggaaagccagagagtgcaaacaaaacagaacaggcaccaaggacaagcgggcaaccaggagagaacgaatgatgagagaacctcactaagcagctactcctgtactgagctcaggaggctggcttcaaggtgaggactcagactccagactgggactccaattgcctgggtttgacagaaccagggaattggtctcaggagccctcaaaaaaaaaaaaaaagagccaagttagaactgggggacagacaaatggggtggcaggacatgtgtgtacctatggtggctgggctcctttaaaagcctttgctctccactgggtccaccctggggcagggcttagtactcagatacacacccaagcggctctacctcaaagcattccagaaaaatgggaattttactgaaaggcttcctggaaaggagaacttatgcca

SEQ ID NO: 290164 - DNA, 1078 bp, Homo sapiens
attgggttgattaggacatgaagcatttattgtgtacaggtatccagataaatggaacttcatcctttaaattttactactgtgttcagttacattattttaaccttggatgaaaaaggtttctcaaacaaatcattctgcttcctacattcttaactgatatcttcgaatcttttattactgagtctagctcgttcttaaaaataccaatgcttggtgatgtctgtgacaagatgatatcccaggaccaactgtgaggtatagcagatcatacccagaacacatcatcccagactactaccttttgggagttcaagttctgatccctcctctccatcagcctttcatgtagctggtagttaccagctggcctctacttgaaattctcctagttaatactcttcacatactgagacatgggatataaagattaccaattttgttgatattgtgtctcagagtaagagggaaaaggatctaagtaaggtgtgcagatactgtctctttacacacagaagtacaatgcttgcatcttggtacacagactttgtgataggtttttttccttgtcatgagcctttttgccatgaaggagccagtatgggaaagtggttaagaacatgagatcttaagtcaaattcctggggtctgaatcccgactctccatcattagttgtgtgacacatgcaaaggacttatcactgagaatggcacatgagtaggccagcaggcactcagggaggataagccacacacacatatacatacgtgctttttttcttctatctggctgcattctcaagagctggagttttgcagttttaaaacctctaaatacttttaggattcaaactgccattttctgcatagtttcttgtataacctttcctgttcccaaatctcagttctctatgatcctccacctaccaaatgcctccatggtagccacacagaaattctggagatgaaatgatactttcttgcccttttaaaacccactgccatggtctgaaagtttatggtcccctcaaaattcatatgttaaaatcctaattcccagggagatggtattagaagg

SEQ ID NO: 290165 - DNA, 616 bp, Homo sapiens
tacattatgaaaaactgaacacatttattcaatttccaacaatcaccaattagaaatgggcttaaatgacaatacaaagaaagctataagcaaacattttgacagggggatgtgaagaattagaacaaactgcttaggaaactacagtgtgtgcctgtgtttgtgtcgtgtgtgtgtgtgtgtgtgtgtgtgtgtgtgtctgtgatgttatcgttcttttcccctccttctaaaattaggtaaaacatttcctaaagatacagagcaaggtaagatttcttcttcagggtaatttccagcagtgggttctcgggggttgatgaggaaaatcttagggaggaaaatgcacttcattttatttttaattttaggtattgtagatgtacctccataattaagaagttttttcatctaaatacttttttttcctgtataaaaggtcctttatgtaatgcataccttttataatacgatacatttagagttcctttcatccatatataagaaaccaatttgtaaatattaagtctcagggttactatgcattggagtaagttatcaggggaagttttagaatatttttccctggagagctttaaaacaaggtacatttttc

SEQ ID NO: 290166 - DNA, 783 bp, Homo sapiens
tacattatgaaaaactgaacacatttattcaatttccaacaatcaccaattagaaatgggcttaaatgacaatacaaagaaagctataagcaaacattttgacagggggatgtgaagaattagaacaaactgcttaggaaactacagtgtgtgcctgtgtttgtgtcgtgtgtgtgtgtgtgtgtgtgtgtgtgtgcagatactgtctctttacacacagaagtacaatgcttgcatcttggtacacagactttgtgataggtttttttccttgtcatgagcctttttgccatgaaggagccagtatgggaaagtggttaagaacatgagatcttaagtcaaattcctggggtctgaatcccgactctccatcattagttgtgtgacacatgcaaaggacttatcactgagaatggcacatgagtaggccagcaggcactcagggaggataagccacacacacatatacatacgtgctttttttcttctatctggctgcattctcaagagctggagttttgcagttttaaaacctctaaatacttttaggattcaaactgccattttctgcatagtttcttgtataacctttcctgttcccaaatctcagttctctatgatcctccacctaccaaatgcctccatggtagccacacagaaattctggagatgaaatgatactttcttgcccttttaaaacccactgccatggtctgaaagtttatggtcccctcaaaattcatatgttaaaatcctaattcccagggagatggtattagaagg

SEQ ID NO: 290167 - DNA, 832 bp, Homo sapiens
gcaggaaatgacgaaggcagagggcgtccaggtccgctcggtaaccgtttcccgcgcgcccggccccgactccggggtaaagagccccggagcggagcagcgctggccgcgtgccgcctccggagccggcagcccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataata

SEQ ID NO: 290168 - DNA, 1482 bp, Homo sapiens
gcaggaaatgacgaaggcagagggcgtccaggtccgctcggtaaccgtttcccgcgcgcccggccccgactccggggtaaagagccccggagcggagcagcgctggccgcgtgccgcctccggagccggcagcccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataataacttcctgtttcattgtattctgtgagtgataagtgtcagatcaataacagattaatttgttgttaacagctcttttttttttttttttttttggagacagagtcttgttgcccagactgggagtgcagtgggcccaattctctggctcactggaaactttccaccttcccggggtttaaacgattcctcctgccacagcctcctgaatattctgttaacagctctttaattaatgatctttgcttcttcagaacttgtatggtagaccgtcttttctacagcatgatgcatactcctgtgctaattttagaagctttctgtaactagatttttcctcattatgctcccaggagcgagtttgtttttatccccgtttcatttctaccaggtagctctactttaggccatactggggacctgctgttgaataaatggatgcctgtgtattggtgttggcaactctgcggtagtagtgctaccactggcgagcagtattactgccactggtgaatgttgctgtctggttactgctgcatttttggcatgctaagctttcctaaagagcctcatatcttttcccatgctgtactgtacaatgaaatgtttttacctaatttttcatgtttatttaaataaaagctgactgggt

SEQ ID NO: 290169 - DNA, 1400 bp, Homo sapiens
agtcccaccccaagcgcgcacagcggagcaggaggcgcccggcactcgcagccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataataacttcctgtttcattgtattctgtgagtgataagtgtcagatcaataacagattaatttgttgttaacagctcttttttttttttttttttttggagacagagtcttgttgcccagactgggagtgcagtgggcccaattctctggctcactggaaactttccaccttcccggggtttaaacgattcctcctgccacagcctcctgaatattctgttaacagctctttaattaatgatctttgcttcttcagaacttgtatggtagaccgtcttttctacagcatgatgcatactcctgtgctaattttagaagctttctgtaactagatttttcctcattatgctcccaggagcgagtttgtttttatccccgtttcatttctaccaggtagctctactttaggccatactggggacctgctgttgaataaatggatgcctgtgtattggtgttggcaactctgcggtagtagtgctaccactggcgagcagtattactgccactggtgaatgttgctgtctggttactgctgcatttttggcatgctaagctttcctaaagagcctcatatcttttcccatgctgtactgtacaatgaaatgtttttacctaatttttcatgtttatttaaataaaagctgactgggt

SEQ ID NO: 290170 - DNA, 1282 bp, Homo sapiens
gcaggaaatgacgaaggcagagggcgtccaggtccgctcggtaaccgtttcccgcgcgcccggccccgactccggggtaaagagccccggagcggagcagcgctggccgcgtgccgcctccggagccggcagcgtgagtggccccgcgtccccgcttctcccggtccccggcggggccgcgtcacccggccccgccccgcgccgcccgccccgccccggacgcgggggtaaggggggtggccgcccgcctgccctcggtcccgtgcggtccccgaaactccgagcacctgcccggtcccggcgcggagcccctcggcgtcgcgtggagctgcgagtcgcccgcttccggaagcgcacacgggccagttgcggcggcccatctgccggggcggcgggggctcggcgggagggttgaggctgaatcacgcgcagcctgcgggcggcggaaacgtccctagagcctcgccgccctgggacccgggctgcttcctgggagaggattacattttctccctgctccacttgactttcttccggaaggagcaggtctcgcaggatcggggccaagactggaagagttcagccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataata

SEQ ID NO: 290171 - DNA, 686 bp, Homo sapiens
ttgagctcgtaccctcgcgaacgtgtatcccatggatatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataata

SEQ ID NO: 290172 - DNA, 733 bp, Homo sapiens
tgcctctatttaaccacccatttatgcccctcctccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataata

SEQ ID NO: 290173 - DNA, 1113 bp, Homo sapiens
gcaggaaatgacgaaggcagagggcgtccaggtccgctcggtaaccgtttcccgcgcgcccggccccgactccggggtaaagagccccggagcggagcagcgctggccgcgtgccgcctccggagccggcagcccccatggctgggggttatggagtgatgggtgacgatggttctattgattatactgttcacgaagcctggaatgaagccaccaatgtttacttgatagttatccttgttagcttcggtctcttcatgtatgccaaaaggatatttggcttttggaggattgaggagaatcacaatggaggaacttcactttgttgtgttaaatggatgtgttcagctacttttctcacagcctcatactttttagtgaaagaaagaatactttgagccaaggaagcagctctcaaagacaaaatagaaagtaaaatggtcttgtcatttaagtccttttaccacagcttctgatgaccaggatcatgagcatattacaactctatagacattaatacaaacatctcttctgcatggattttgtgtttaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataata

SEQ ID NO: 290174 - DNA, 838 bp, Homo sapiens
caccatggagtttactaaccatacacgacgacgtttctgatcgacgctacagtgaggatgaaccttgaaacttcattgtaaataaaagccagccggctgggtgtggtggctcacgcctgtaatcccaggactttgggaggccaaggtgggcggatcactaggtcaggagatcgagaccctcctggctaacacagtgaaaccccgtctctactaaaaatacaaaaaattagctgggtgtggtggtgggcacctgtagtctcagctactcgggaggctgagccaggagaatggcgtgaacccaggaggcagaggttgcagtgagccgagatcgcgccactgcaccccagcctgggcgacagagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataata

SEQ ID NO: 290175 - DNA, 442 bp, Homo sapiens
cacagggttacattctgatgttggagcggccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataata

SEQ ID NO: 290176 - DNA, 548 bp, Homo sapiens
agctttagtgccgcccagcagggttgttgggataattcagtgactctgtggactgcccagcacctgtgaattgctttcctggatgttgggtgaaggcctgtgagcttgtatgtaccctttggcttcagaataccaagcctttagtgtttcagagggatgagagaaagaaatcccattttttgatgcagaggattttgttgtaagggactctaggaactaagtggttccaatgtgaatttgtatcaaagtaacaaagttctaagtgagagacaaaaatgataacattcaaggcacgatgacaagcggtggtcaattttagaatcacctagacgtgacatcaggaacccaaaatcacgacacagattttaaagcttatgatacagtgacctagtccctagaaaaagtagttctcggctgggcacggtggctcacgcctgtaatcccagcactttgggaggctgaggcgggcggattgcctgagctcaggagttttgagaccagcctgggcagtatagtgagacgacccccaccccacccccgtctttaaa

SEQ ID NO: 290177 - DNA, 750 bp, Homo sapiens
agtcccaccccaagcgcgcacagcggagcaggaggcgcccggcactcgcagccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataata

SEQ ID NO: 290178 - DNA, 1500 bp, Homo sapiens
gcaggaaatgacgaaggcagagggcgtccaggtccgctcggtaaccgtttcccgcgcgcccggccccgactccggggtaaagagccccggagcggagcagcgctggccgcgtgccgcctccggagccggcagcgtgagtggccccgcgtccccgcttctcccggtccccggcggggccgcgtcacccggccccgccccgcgccgcccgccccgccccggacgcgggggtaaggggggtggccgcccgcctgccctcggtcccgtgcggtccccgaaactccgagcacctgcccggtcccggcgcggagcccctcggcgtcgcgtggagctgcgagtcgcccgcttccggaagcgcacacgggccagttgcggcggcccatctgccggggcggcgggggctcggcgggagggttgaggctgaatcacgcgcagcctgcgggcggcggaaacgtccctagagcctcgccgccctgggacccgggctgcttcctgggagaggattacattttctccctgctccacttgactttcttccggaaggagcaggtctcgcaggatcggggccaagactggaagagttcaggtttgggagtcgtgtgtataacagccccgcgcctccacgcccaggcctgtgtggctttggacaagttatataaccaccgccgccaccccagtttcttctcctgtaaaatggagctttagtgccgcccagcagggttgttgggataattcagtgactctgtggactgcccagcacctgtgaattgctttcctggatgttgggtgaaggcctgtgagcttccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataata

SEQ ID NO: 290179 - DNA, 1781 bp, Homo sapiens
gcaggaaatgacgaaggcagagggcgtccaggtccgctcggtaaccgtttcccgcgcgcccggccccgactccggggtaaagagccccggagcggagcagcgctggccgcgtgccgcctccggagccggcagcgtgagtggccccgcgtccccgcttctcccggtccccggcggggccgcgtcacccggccccgccccgcgccgcccgccccgccccggacgcgggggtaaggggggtggccgcccgcctgccctcggtcccgtgcggtccccgaaactccgagcacctgcccggtcccggcgcggagcccctcggcgtcgcgtggagctgcgagtcgcccgcttccggaagcgcacacgggccagttgcggcggcccatctgccggggcggcgggggctcggcgggagggttgaggctgaatcacgcgcagcctgcgggcggcggaaacgtccctagagcctcgccgccctgggacccgggctgcttcctgggagaggattacattttctccctgctccacttgactttcttccggaaggagcaggtctcgcaggatcggggccaagactggaagagttcaggtttgggagtcgtgtgtataacagccccgcgcctccacgcccaggcctgtgtggctttggacaagttatataaccaccgccgccaccccagtttcttctcctgtaaaatggagctttagtgccgcccagcagggttgttgggataattcagtgactctgtggactgcccagcacctgtgaattgctttcctggatgttgggtgaaggcctgtgagcttccccatggctgggggttatggagtgatgggtgacgatggttctattgattatactgttcacgaagcctggaatgaagccaccaatgtttacttgatagttatccttgttagcttcggtctcttcatgtatgccaaaaggatatttggcttttggaggattgaggagaatcacaatggaggaacttcactttgttgtgttaaatggatgtgttcagctacttttctcacagcctcatactttttagtgaaagaaagaatactttgagccaaggaagcagctctcaaagacaaaatagaaagtaaaatggtcttgtcatttaagtccttttaccacagcttctgatgaccaggatcatgagcatattacaactctatagacattaatacaaacatctcttctgcatggattttgtgtttaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataata

SEQ ID NO: 290180 - DNA, 694 bp, Homo sapiens
gcaggaaatgacgaaggcagagggcgtccaggtccgctcggtaaccgtttcccgcgcgcccggccccgactccggggtaaagagccccggagcggagcagcgctggccgcgtgccgcctccggagccggcagcgaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataata

SEQ ID NO: 290181 - DNA, 1281 bp, Homo sapiens
gcaggaaatgacgaaggcagagggcgtccaggtccgctcggtaaccgtttcccgcgcgcccggccccgactccggggtaaagagccccggagcggagcagcgctggccgcgtgccgcctccggagccggcagcgtgagtggccccgcgtccccgcttctcccggtccccggcggggccgcgtcacccggccccgccccgcgccgcccgccccgccccggacgcgggggtaaggggggtggccgcccgcctgccctcggtcccgtgcggtccccgaaactccgagcacctgcccggtcccggcgcggagcccctcggcgtcgcgtggagctgcgagtcgcccgcttccggaagcgcacacgggccagttgcggcggcccatctgccggggcggcgggggctcggcgggagggttgaggctgaatcacgcgcagcctgcgggcggcggaaacgtccctagagcctcgccgccctgggacccgggctgcttcctgggagaggattacattttctccctgctccacttgactttcttccggaaggagcaggtctcgcaggatcggggccaagactggaagagttcaggtttgggagtcgtgtgtataacagccccgcgcctccacgcccaggcctgtgtggctttggacaagttatataaccaccgccgccaccccagtttcttctcctgtaaaatggagctttagtgccgcccagcagggttgttgggataattcagtgactctgtggactgcccagcacctgtgaattgctttcctggatgttgggtgaaggcctgtgagcttccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtatacattaatatgcatgaatgctcatgtatacaggccggctg

SEQ ID NO: 290182 - DNA, 1001 bp, Homo sapiens
  misc_feature (3)..(3): n is a, c, g, or t
  misc_feature (5)..(6): n is a, c, g, or t
ggncnnggctgctacaggggctcccagcggcctcccgcaccgaagggaccctgggcgtctgaggccctgatccgggcgggccttcaggatgttagcagtccctgtccggttgaaggtaggaagccgaaaacccgagtgggggacgaacagacttacctcctgtcccgcaaaagatccactagatcgtcgtctccaaaacctgagagaccgcgaacgggttccagagccgcagcgttctctcagacctggcgttcaggaagattctagagagcacgggcaggtcccggaggtctcagacccgcaggcctgcggggcgggggcggggtggcgcccaggacgactccccgggctcagcttggctgcctgcctccttctgtaagtgctttttttttcttcacctgggaccctctagaggttggaaagagaagagaggctgggagcggatggaaagcatgactgcatctggagcccctggggggagtggggaagagggagtggaaggacagtggctgaggggcttcctgttgcagccttcagctggactcagggttggggtcactggaggaggaggtggcttcctgccccattgttctggactgcagtgtttcttgggaatacttactgtatgtggattttcagtaaccaacttggaaagctgtatttgttcccatgattcagcaaacaatgagtacctactgtgtgtagaagcagcaggacagcctgtcatcactgggaaagaggccagaagagccgtttggccagggtctccaatttaggctttcaacattatctctaaagaaggttatacattatgtcggctccactggctgatgggatcaaagaccctccttgtatatccttaaacctgtactctattaccaggccactgtgcctgtggagcactgtaagttcctaccttttaataaattttataattatcttgtgagcagcaaaattgtcatagttttttgtatcagaaacattaatttgttaaacatttt

SEQ ID NO: 290183 - DNA, 737 bp, Homo sapiens
  misc_feature (3)..(3): n is a, c, g, or t
  misc_feature (5)..(6): n is a, c, g, or t
ggncnnggctgctacaggggctcccagcggcctcccgcaccgaagggaccctgggcgtctgaggccctgatccgggcgggccttcaggatgttagcagtccctgtccggttgaaggtaggaagccgaaaacccgagtgggggacgaacagacttacctcctgtcccgcaaaagatccactagatcgtcgtctccaaaacctgagagaccgcgaacgggttccagagccgcagcgttctctcagacctggcgttcaggaagattctagagagcacgggcaggtcccggaggtctcagacccgcaggcctgcggggcgggggcggggtggcgcccaggacgactccccgggctcagcttggctgcctgcctccttcttaaccaacttggaaagctgtatttgttcccatgattcagcaaacaatgagtacctactgtgtgtagaagcagcaggacagcctgtcatcactgggaaagaggccagaagagccgtttggccagggtctccaatttaggctttcaacattatctctaaagaaggttatacattatgtcggctccactggctgatgggatcaaagaccctccttgtatatccttaaacctgtactctattaccaggccactgtgcctgtggagcactgtaagttcctaccttttaataaattttataattatcttgtgagcagcaaaattgtcatagttttttgtatcagaaacattaatttgttaaacatttt

SEQ ID NO: 290184 - DNA, 698 bp, Homo sapiens
  misc_feature (3)..(3): n is a, c, g, or t
  misc_feature (5)..(6): n is a, c, g, or t
ggncnnggctgctacaggggctcccagcggcctcccgcaccgaagggaccctgggcgtctgaggccctgatccgggcgggccttcaggatgttagcagtccctgtccggttgaaggtaggaagccgaaaacccgagtgggggacgaacagacttacctcctgtcccgcaaaagatccactagatcgtcgtctccaaaacctgagagaccgcgaacgggttccagagccgcagcgttctctcagacctggcgttcaggaagattctagagagcacgggcaggtcccggaggtctcagacccgcaggcctgcggggcgggggcggggtggcgcccaggacgactccccgggctcagcttggctgcctgcctccttctcaaacaatgagtacctactgtgtgtagaagcagcaggacagcctgtcatcactgggaaagaggccagaagagccgtttggccagggtctccaatttaggctttcaacattatctctaaagaaggttatacattatgtcggctccactggctgatgggatcaaagaccctccttgtatatccttaaacctgtactctattaccaggccactgtgcctgtggagcactgtaagttcctaccttttaataaattttataattatcttgtgagcagcaaaattgtcatagttttttgtatcagaaacattaatttgttaaacatttt

SEQ ID NO: 290185 - DNA, 1473 bp, Homo sapiens
ctacaatccccagcaggcaccgcgcgtcaggctctctcttcccccccatcttagtggcctgagcggcttgaccagagctgctgcaactgcagcaagaggtagggctcaggcgttgggaattgcaccgacaggcagtcgcacagaaaggcacacagatgtagtggtgtgcatagcccttgacagcgaataggaggacagtacaggacatgagtcctggtgagggacccgaggagcaggacagagaagacggcccctgaatcccatttggccccttgctggctggaggtgtgaaaaccagcggtggaggcagccttcggggcctgcatttgagaataagggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggccccctacaacaccacccagttcctgatgaatgacagggacccggaggagcccaacttggatgtgccccatgggatctcccacccaggttccagtggggagagtgaggccggggacagtgatgggcggggccgagcgcacggtgagttccagcggaaggacttctctgagacttacgaacgcttccacaccgagagcctgcagggccgcagcaagcaggagctggtgcgagactacctggagctggagaagcggctgtcgcaggcggaggaggagactaggaggctgcagcagctgcaggcgtgcaccggccagcagtcctgccgccaggtggaggagctggctgccgaggtccagaggctccggaccgaaaaccagcggcttcgtcaggagaaccagatgtggaaccgagagggctgccgctgtgatgaggagccgggtacctaggggtgcctcccagcctggtggacccaaggagaaggtcccatttcgtgcacactcaggccagctgggtctcaaggaggcaggtggcagatgaaaaccaccgtcaacaccctgtgcgccctgagaacagctaaatcggttcagactcccacctcaccgtttccatagttggctcttttgtgtcatcttaccctttacagagaaattaaatggccttggtgggaccaaaaaga

SEQ ID NO: 290186 - DNA, 2046 bp, Homo sapiens
taagaagctgctacagctataatgtaaggttaagagtttattctttcaaagcaggtctcctcatctcttaaacgctatacatatgaagtagataaaaactggtttcttttttggtagcatttaggatctacaaaagtgatccttcaattacttggaatttcaaaaaattgaggttacctagtaacaatgcaccagtagaacacaaaatactctgactttgtttagtctgtgggaaaagaaaaatctttaaactggaaagattttgtagtcttacaaagattacattggaattggaattactgtagttcgtttttccctctaggagggcagccatttctctaaaagttgtgtaaaagttaagactaggatttcaaaatgcaagcagatgttgatgaagcatacgaaatgggcaactccgtttctatttcggagccgcagcgactccgactttgtgccccaaccctgtaaagggcaaaacctcatcccttcggtgtaaactttcaagagaagtggggcagcacactttaggcgtttcaccaagaggctggcgacatgctaggtcaggttgtccggagaatcggggctgaatgggagagatcttgagggcaagagcctcagagaccttcaggcaccgagctcgtgaaggtttccaagtgcccctctctagctgctcccagggggaattagtggttgctacagtagtttaagagggtcgtggtttttcgcaacccgggcggcgagatggcgctttggtgtaagcgaggaggacagtacaggacatgagtcctggtgagggacccgaggagcaggacagagaagacggcccctgaatcccatttggccccttgctggctggaggtgtgaaaaccagcggtggaggcagccttcggggcctgcatttgagaataagggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggccccctacaacaccacccagttcctgatgaatgacagggacccggaggagcccaacttggatgtgccccatgggatctcccacccaggttccagtggggagagtgaggccggggacagtgatgggcggggccgagcgcacggtgagttccagcggaaggacttctctgagacttacgaacgcttccacaccgagagcctgcagggccgcagcaagcaggagctggtgcgagactacctggagctggagaagcggctgtcgcaggcggaggaggagactaggaggctgcagcagctgcaggcgtgcaccggccagcagtcctgccgccaggtggaggagctggctgccgaggtccagaggctccggaccgaaaaccagcggcttcgtcaggagaaccagatgtggaaccgagagggctgccgctgtgatgaggagccgggtacctaggggtgcctcccagcctggtggacccaaggagaaggtcccatttcgtgcacactcaggccagctgggtctcaaggaggcaggtggcagatgaaaaccaccgtcaacaccctgtgcgccctgagaacagctaaatcggttcagactcccacctcaccgtttccatagttggctcttttgtgtcatcttaccctttacagagaaattaaatggccttggtgggaccaaaaaga

SEQ ID NO: 290187 - DNA, 2351 bp, Homo sapiens
taagaagctgctacagctataatgtaaggttaagagtttattctttcaaagcaggtctcctcatctcttaaacgctatacatatgaagtagataaaaactggtttcttttttggtagcatttaggatctacaaaagtgatccttcaattacttggaatttcaaaaaattgaggttacctagtaacaatgcaccagtagaacacaaaatactctgactttgtttagtctgtgggaaaagaaaaatctttaaactggaaagattttgtagtcttacaaagattacattggaattggaattactgtagttcgtttttccctctaggagggcagccatttctctaaaagttgtgtaaaagttaagactaggatttcaaaatgcaagcagatgttgatgaagcatacgaaatgggcaactccgtttctatttcggagccgcagcgactccgactttgtgccccaaccctgtaaagggcaaaacctcatcccttcggtgtaaactttcaagagaagtggggcagcacactttaggcgtttcaccaagaggctggcgacatgctaggtcaggttgtccggagaatcggggctgaatgggagagatcttgagggcaagagcctcagagaccttcaggcaccgagctcgtgaaggtttccaagtgcccctctctagctgctcccagggggaattagtggttgctacagtagtttaagagggtcgtggtttttcgcaacccgggcggcgagatggcgctttggtgtaagcgaggtaaggtgggtgcactgggatctccgctctcggagcctccagctgactgccacgccgacttgtggccagacctgcgacctccgccctcccccgcggcgccagcctctggaatctggcgtcgcccccacctctccagtcgaagtgggagtccctctgtgcggggcctcgccgccatacccaggccgaatgggggtggggagggaagctggcagagctcggcctcaggatccgcgcccctgtggaaagaccgcagagggaagccgtttcaccagcctctccccttctggggtctcgggaaacacgcggaggacagtacaggacatgagtcctggtgagggacccgaggagcaggacagagaagacggcccctgaatcccatttggccccttgctggctggaggtgtgaaaaccagcggtggaggcagccttcggggcctgcatttgagaataagggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggccccctacaacaccacccagttcctgatgaatgacagggacccggaggagcccaacttggatgtgccccatgggatctcccacccaggttccagtggggagagtgaggccggggacagtgatgggcggggccgagcgcacggtgagttccagcggaaggacttctctgagacttacgaacgcttccacaccgagagcctgcagggccgcagcaagcaggagctggtgcgagactacctggagctggagaagcggctgtcgcaggcggaggaggagactaggaggctgcagcagctgcaggcgtgcaccggccagcagtcctgccgccaggtggaggagctggctgccgaggtccagaggctccggaccgaaaaccagcggcttcgtcaggagaaccagatgtggaaccgagagggctgccgctgtgatgaggagccgggtacctaggggtgcctcccagcctggtggacccaaggagaaggtcccatttcgtgcacactcaggccagctgggtctcaaggaggcaggtggcagatgaaaaccaccgtcaacaccctgtgcgccctgagaacagctaaatcggttcagactcccacctcaccgtttccatagttggctcttttgtgtcatcttaccctttacagagaaattaaatggccttggtgggaccaaaaaga

SEQ ID NO: 290188 - DNA, 1224 bp, Homo sapiens
acaacactacttacgggctacggttacgaggaccctcgggtgttttaatcggcgcggcttgaccagagctgctgcaactgcagcaagaggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggccccctacaacaccacccagttcctgatgaatgacagggacccggaggagcccaacttggatgtgccccatgggatctcccacccaggttccagtggggagagtgaggccggggacagtgatgggcggggccgagcgcacggtgagttccagcggaaggacttctctgagacttacgaacgcttccacaccgagagcctgcagggccgcagcaagcaggagctggtgcgagactacctggagctggagaagcggctgtcgcaggcggaggaggagactaggaggctgcagcagctgcaggcgtgcaccggccagcagtcctgccgccaggtggaggagctggctgccgaggtccagaggctccggaccgaaaaccagcggcttcgtcaggagaaccagatgtggaaccgagagggctgccgctgtgatgaggagccgggtacctaggggtgcctcccagcctggtggacccaaggagaaggtcccatttcgtgcacactcaggccagctgggtctcaaggaggcaggtggcagatgaaaaccaccgtcaacaccctgtgcgccctgagaacagctaaatcggttcagactcccacctcaccgtttccatagttggctcttttgtgtcatcttaccctttacagagaaattaaatggccttggtgggaccaaaaaga

SEQ ID NO: 290189 - DNA, 1316 bp, Homo sapiens
acaacactacttacgggctacggttacgaggaccctcgggtgttttaatcggcgcggcttgaccagagctgctgcaactgcagcaagaggtagggctcaggcgttgggaattgcaccgacaggcagtcgcacagaaaggcacacagatgtagtggtgtgcatagcccttgacagcgaataggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggccccctacaacaccacccagttcctgatgaatgacagggacccggaggagcccaacttggatgtgccccatgggatctcccacccaggttccagtggggagagtgaggccggggacagtgatgggcggggccgagcgcacggtgagttccagcggaaggacttctctgagacttacgaacgcttccacaccgagagcctgcagggccgcagcaagcaggagctggtgcgagactacctggagctggagaagcggctgtcgcaggcggaggaggagactaggaggctgcagcagctgcaggcgtgcaccggccagcagtcctgccgccaggtggaggagctggctgccgaggtccagaggctccggaccgaaaaccagcggcttcgtcaggagaaccagatgtggaaccgagagggctgccgctgtgatgaggagccgggtacctaggggtgcctcccagcctggtggacccaaggagaaggtcccatttcgtgcacactcaggccagctgggtctcaaggaggcaggtggcagatgaaaaccaccgtcaacaccctgtgcgccctgagaacagctaaatcggttcagactcccacctcaccgtttccatagttggctcttttgtgtcatcttaccctttacagagaaattaaatggccttggtgggaccaaaaaga

SEQ ID NO: 290190 - DNA, 1464 bp, Homo sapiens
acaacactacttacgggctacggttacgaggaccctcgggtgttttaatcggcgcggcttgaccagagctgctgcaactgcagcaagaggtagggctcaggcgttgggaattgcaccgacaggcagtcgcacagaaaggcacacagatgtagtggtgtgcatagcccttgacagcgaataggaggacagtacaggacatgagtcctggtgagggacccgaggagcaggacagagaagacggcccctgaatcccatttggccccttgctggctggaggtgtgaaaaccagcggtggaggcagccttcggggcctgcatttgagaataagggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggccccctacaacaccacccagttcctgatgaatgacagggacccggaggagcccaacttggatgtgccccatgggatctcccacccaggttccagtggggagagtgaggccggggacagtgatgggcggggccgagcgcacggtgagttccagcggaaggacttctctgagacttacgaacgcttccacaccgagagcctgcagggccgcagcaagcaggagctggtgcgagactacctggagctggagaagcggctgtcgcaggcggaggaggagactaggaggctgcagcagctgcaggcgtgcaccggccagcagtcctgccgccaggtggaggagctggctgccgaggtccagaggctccggaccgaaaaccagcggcttcgtcaggagaaccagatgtggaaccgagagggctgccgctgtgatgaggagccgggtacctaggggtgcctcccagcctggtggacccaaggagaaggtcccatttcgtgcacactcaggccagctgggtctcaaggaggcaggtggcagatgaaaaccaccgtcaacaccctgtgcgccctgagaacagctaaatcggttcagactcccacctcaccgtttccatagttggctcttttgtgtcatcttaccctttacagagaaattaaatggccttggtgggaccaaaaaga

SEQ ID NO: 290191 - DNA, 2355 bp, Homo sapiens
taagaagctgctacagctataatgtaaggttaagagtttattctttcaaagcaggtctcctcatctcttaaacgctatacatatgaagtagataaaaactggtttcttttttggtagcatttaggatctacaaaagtgatccttcaattacttggaatttcaaaaaattgaggttacctagtaacaatgcaccagtagaacacaaaatactctgactttgtttagtctgtgggaaaagaaaaatctttaaactggaaagattttgtagtcttacaaagattacattggaattggaattactgtagttcgtttttccctctaggagggcagccatttctctaaaagttgtgtaaaagttaagactaggatttcaaaatgcaagcagatgttgatgaagcatacgaaatgggcaactccgtttctatttcggagccgcagcgactccgactttgtgccccaaccctgtaaagggcaaaacctcatcccttcggtgtaaactttcaagagaagtggggcagcacactttaggcgtttcaccaagaggctggcgacatgctaggtcaggttgtccggagaatcggggctgaatgggagagatcttgagggcaagagcctcagagaccttcaggcaccgagctcgtgaaggtttccaagtgcccctctctagctgctcccagggggaattagtggttgctacagtagtttaagagggtcgtggtttttcgcaacccgggcggcgagatggcgctttggtgtaagcgaggtaaggtgggtgcactgggatctccgctctcggagcctccagctgactgccacgccgacttgtggccagacctgcgacctccgccctcccccgcggcgccagcctctggaatctggcgtcgcccccacctctccagtcgaagtgggagtccctctgtgcggggcctcgccgccatacccaggccgaatgggggtggggagggaagctggcagagctcggcctcaggatccgcgcccctgtggaaagaccgcagagggaagccgtttcaccagcctctccccttctggggtctcgggaaacacgcggtaattaccgaagaaccccgcactctgtgagaggcgaggctgcggggctgccgggacggtttgaggaccgggctcggccgaggagactccaaccttcaccctccctggcccccggtcccacttcccgccgtctcccggcgccgccacttcaggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggccccctacaacaccacccagttcctgatgaatgacagggacccggaggagcccaacttggatgtgccccatgggatctcccacccaggttccagtggggagagtgaggccggggacagtgatgggcggggccgagcgcacggtgagttccagcggaaggacttctctgagacttacgaacgcttccacaccgagagcctgcagggccgcagcaagcaggagctggtgcgagactacctggagctggagaagcggctgtcgcaggcggaggaggagactaggaggctgcagcagctgcaggcgtgcaccggccagcagtcctgccgccaggtggaggagctggctgccgaggtccagaggctccggaccgaaaaccagcggcttcgtcaggagaaccagatgtggaaccgagagggctgccgctgtgatgaggagccgggtacctaggggtgcctcccagcctggtggacccaaggagaaggtcccatttcgtgcacactcaggccagctgggtctcaaggaggcaggtggcagatgaaaaccaccgtcaacaccctgtgcgccctgagaacagctaaatcggttcagactcccacctcaccgtttccatagttggctcttttgtgtcatcttaccctttacagagaaattaaatggccttggtgggaccaaaaaga

SEQ ID NO: 290192 - DNA, 1158 bp, Homo sapiens
gctggtactggccggaattttgggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggccccctacaacaccacccagttcctgatgaatgacagggacccggaggagcccaacttggatgtgccccatgggatctcccacccaggttccagtggggagagtgaggccggggacagtgatgggcggggccgagcgcacggtgagttccagcggaaggacttctctgagacttacgaacgcttccacaccgagagcctgcagggccgcagcaagcaggagctggtgcgagactacctggagctggagaagcggctgtcgcaggcggaggaggagactaggaggctgcagcagctgcaggcgtgcaccggccagcagtcctgccgccaggtggaggagctggctgccgaggtccagaggctccggaccgaaaaccagcggcttcgtcaggagaaccagatgtggaaccgagagggctgccgctgtgatgaggagccgggtacctaggggtgcctcccagcctggtggacccaaggagaaggtcccatttcgtgcacactcaggccagctgggtctcaaggaggcaggtggcagatgaaaaccaccgtcaacaccctgtgcgccctgagaacagctaaatcggttcagactcccacctcaccgtttccatagttggctcttttgtgtcatcttaccctttacagagaaattaaatggccttggtgggaccaaaaaga

SEQ ID NO: 290193 - DNA, 2384 bp, Homo sapiens
gcacaatctctctctcacacacacacacacacacacacacacacacactcactcactctattttgtgctgtcgtaaaacccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcgctggctggtctctcggccctgccggtgtcgcagctgccggtgttcgcgcctctagccgccgctgccgtcgccgccgagccgctgccccccaaggaactgtgcctcggcgccacctccggccccgggcccgtcaagtgcggtggtggtggcggcggcggcggggagggtcgcggcgccccgcgcttccgctgcagcgcagaggagctggactattacctgtatggccagcagcgcatggagatcatcccgctcaaccagcacaccagcgaccccaacaaccgttgcgacatgtgcgcggacaaccgcaacggcgagtgccctatgcatgggccactgcactcgctgcgccggcttgtgggcaccagcagcgctgcggccgccgcgcccccgccggagctgccggagtggctgcgggacctgcctcgcgaggtgtgcctctgcaccagtactgtgcccggcctggcctacggcatctgcgcggcgcagaggatccagcaaggcacctggattggacctttccaaggcgtgcttctgcccccagagaaggtgcaggcaggcgccgtgaggaacacgcagcatctctgggagtaaatgtcccttcaacggtaatggaagccatgtgcagacaagacgccctgcagcccttcaacaaaagcagcaaactcgcccctaccacccagcagcgctccgttgttttcccccagactccgtgcagcaggaacttctctcttctggataagtctgggcccattgaatcaggatttaatcaaatcaacgtgaaaaaccagcgagtcctggcaagcccaacttccacaagccagctccactcggagttcagtgactggcatctttggaaatgtgggcagtgctttaagactttcacccagcggatcctcttacagatgcacgtgtgcacgcagaaccccgacagaccctaccaatgcggccactgctcccagtccttttcccagccttcagaactgaggaaccacgtggtcactcactctagtgaccggcctttcaagtgcggctactgtggtcgtgcctttgccggggccaccaccctcaacaaccacatccgaacccacactggagaaaagcccttcaagtgcgagaggtgtgagaggagcttcacgcaggccacccagctgagccgacaccagcggatgcccaatgagtgcaagccaataactgagagcccagaatcaatcgaagtggattaacggattgactggttggaattaaactgcaaggaaagtcatgattaaatgtcacggacacttaagcaaaaccaaagatttcctctgagcaactttcaatcagtcccagaaaaccaaaagcagtaataaaataagtaagatgttaagagatattgatcctggcatggaagtcagaccaggaaagagattatttatttatgacttagggatgagacttatttcagtggacaactaacctgggatggtaaacattcccagtcccaccatgtattttgctttgtttctaaaaagctttttaaaaactgttatttaataccaaagggaggaatcgtatgggttcttctgcccaccgttgtgactaagaatgcacagggacttggttctcgttgcacctttttttagtaacatgtttcatggggacccactgtacagcccttcattctgctgtgtcagtttggcctggcctgacactggctgccccagcggggaccacggaagcagagtgagagccttcgctgagtcaatgctaccttcagccccagacgcatcccatttccatgtcttccatgctcactgctcatgcactttttacacggtttcttccaaacagcccggtcttgatgcaggagagtctggaaaaggaagaaaatggtttcagtttcaaaattcaaaggaaaaagttgaggacttattttgtcctgtcaagattgcaagaacatgtaaaatgtacggagcttcataatacgttatattgttccgaagcagctcgttgagaaacatttgttttcaataacattttagcttaaaaaaaaa

SEQ ID NO: 290194 - DNA, 697 bp, Homo sapiens
gcacaatctctctctcacacacacacacacacacacacacacacacactcactcactctattttgtgctgtcgtaaaacccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcacgcacccaccggcagcaccgagttttcagttcgaggcgccggacatgctgaagcccggagaccccggcggttcggccttcctcaaagtggacccagcctacctgcagcactggcagcaactcttccctcacggaggcgcaggcccgctcaagggcagcggcgccgcgggtctcctgagcgcgccgcagcctcttcagccgccgccgccgcccccgcccccggagcgcgctgagcctccgccggacagcctgcgcccgcggcccgcctctctctcctccgcctcgtccacgccggcttcctcttccacctccgcctcctccgcctcctcctgcgctgctgcggccgc

SEQ ID NO: 290195 - DNA, 2512 bp, Homo sapiens
gcacaatctctctctcacacacacacacacacacacacacacacacactcactcactctattttgtgctgtcgtaaaacccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcgctggctggtctctcggccctgccggtgtcgcagctgccggtgttcgcgcctctagccgccgctgccgtcgccgccgagccgctgccccccaaggaactgtgcctcggcgccacctccggccccgggcccgtcaagtgcggtggtggtggcggcggcggcggggagggtcgcggcgccccgcgcttccgctgcagcgcagaggagctggactattacctgtatggccagcagcgcatggagatcatcccgctcaaccagcacaccagcgaccccaacaaccgttgcgacatgtgcgcggacaaccgcaacggcgagtgccctatgcatgggccactgcactcgctgcgccggcttgtgggcaccagcagcgctgcggccgccgcgcccccgccggagctgccggagtggctgcgggacctgcctcgcgaggtgtgcctctgcaccagtactgtgcccggcctggcctacggcatctgcgcggcgcagaggatccagcaaggcacctggattggacctttccaaggcgtgcttctgcccccagagaaggtgcaggcaggcgccgtgaggaacacgcagcatctctgggagatatatgaccaggatgggacactacagcactttattgatggtggggaacctagtaagtcgagctggatgaggtatatccgatgtgcaaggcactgcggagaacagaatctaacagtagttcagtacagtaaatgtcccttcaacggtaatggaagccatgtgcagacaagacgccctgcagcccttcaacaaaagcagcaaactcgcccctaccacccagcagcgctccgttgttttcccccagactccgtgcagcaggaacttctctcttctggataagtctgggcccattgaatcaggatttaatcaaatcaacgtgaaaaaccagcgagtcctggcaagcccaacttccacaagccagctccactcggagttcagtgactggcatctttggaaatgtgggcagtgctttaagactttcacccagcggatcctcttacagatgcacgtgtgcacgcagaaccccgacagaccctaccaatgcggccactgctcccagtccttttcccagccttcagaactgaggaaccacgtggtcactcactctagtgaccggcctttcaagtgcggctactgtggtcgtgcctttgccggggccaccaccctcaacaaccacatccgaacccacactggagaaaagcccttcaagtgcgagaggtgtgagaggagcttcacgcaggccacccagctgagccgacaccagcggatgcccaatgagtgcaagccaataactgagagcccagaatcaatcgaagtggattaacggattgactggttggaattaaactgcaaggaaagtcatgattaaatgtcacggacacttaagcaaaaccaaagatttcctctgagcaactttcaatcagtcccagaaaaccaaaagcagtaataaaataagtaagatgttaagagatattgatcctggcatggaagtcagaccaggaaagagattatttatttatgacttagggatgagacttatttcagtggacaactaacctgggatggtaaacattcccagtcccaccatgtattttgctttgtttctaaaaagctttttaaaaactgttatttaataccaaagggaggaatcgtatgggttcttctgcccaccgttgtgactaagaatgcacagggacttggttctcgttgcacctttttttagtaacatgtttcatggggacccactgtacagcccttcattctgctgtgtcagtttggcctggcctgacactggctgccccagcggggaccacggaagcagagtgagagccttcgctgagtcaatgctaccttcagccccagacgcatcccatttccatgtcttccatgctcactgctcatgcactttttacacggtttcttccaaacagcccggtcttgatgcaggagagtctggaaaaggaagaaaatggtttcagtttcaaaattcaaaggaaaaagttgaggacttattttgtcctgtcaagattgcaagaacatgtaaaatgtacggagcttcataatacgttatattgttccgaagcagctcgttgagaaacatttgttttcaataacattttagcttaaaaaaaaa

SEQ ID NO: 290196 - DNA, 1185 bp, Homo sapiens
gagactcctgtcttatcatggaccctgatgggcttatttgattcagatgtccaagtgtggaattgccagcctttccagatgagaccctaccaatgcggccactgctcccagtccttttcccagccttcagaactgaggaaccacgtggtcactcactctagtgaccggcctttcaagtgcggctactgtggtcgtgcctttgccggggccaccaccctcaacaaccacatccgaacccacactggagaaaagcccttcaagtgcgagaggtgtgagaggagcttcacgcaggccacccagctgagccgacaccagcggatgcccaatgagtgcaagccaataactgagagcccagaatcaatcgaagtggattaacggattgactggttggaattaaactgcaaggaaagtcatgattaaatgtcacggacacttaagcaaaaccaaagatttcctctgagcaactttcaatcagtcccagaaaaccaaaagcagtaataaaataagtaagatgttaagagatattgatcctggcatggaagtcagaccaggaaagagattatttatttatgacttagggatgagacttatttcagtggacaactaacctgggatggtaaacattcccagtcccaccatgtattttgctttgtttctaaaaagctttttaaaaactgttatttaataccaaagggaggaatcgtatgggttcttctgcccaccgttgtgactaagaatgcacagggacttggttctcgttgcacctttttttagtaacatgtttcatggggacccactgtacagcccttcattctgctgtgtcagtttggcctggcctgacactggctgccccagcggggaccacggaagcagagtgagagccttcgctgagtcaatgctaccttcagccccagacgcatcccatttccatgtcttccatgctcactgctcatgcactttttacacggtttcttccaaacagcccggtcttgatgcaggagagtctggaaaaggaagaaaatggtttcagtttcaaaattcaaaggaaaaagttgaggacttattttgtcctgtcaagattgcaagaacatgtaaaatgtacggagcttcataatacgttatattgttccgaagcagctcgttgagaaacatttgttttcaataacattttagcttaaaaaaaaa

SEQ ID NO: 290197 - DNA, 1654 bp, Homo sapiens
gcacaatctctctctcacacacacacacacacacacacacacacacactcactcactctattttgtgctgtcgtaaaacccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcgctggctggtctctcggccctgccggtgtcgcagctgccggtgttcgcgcctctagccgccgctgccgtcgccgccgagccgctgccccccaaggaactgtgcctcggcgccacctccggccccgggcccgtcaagtgcggtggtggtggcggcggcggcggggagggtcgcggcgccccgcgcttccgctgcagcgcagaggagctggactattacctgtatggccagcagcgcatggagatcatcccgctcaaccagcacaccagcgaccccaacaaccgttgcgacatgtgcgcggacaaccgcaacggcgagtgccctatgcatgggccactgcactcgctgcgccggcttgtgggcaccagcagcgctgcggccgccgcgcccccgccggagctgccggagtggctgcgggacctgcctcgcgaggtgtgcctctgcaccagtactgtgcccggcctggcctacggcatctgcgcggcgcagaggatccagcaaggcacctggattggacctttccaaggcgtgcttctgcccccagagaaggtgcaggcaggcgccgtgaggaacacgcagcatctctgggagatatatgaccaggatgggacactacagcactttattgatggtggggaacctagtaagtcgagctggatgaggtatatccgatgtgcaaggcactgcggagaacagaatctaacagtagttcagtacagtaaatgtcccttcaacggtaatggaagccatgtgcagacaagacgccctgcagcccttcaacaaaagcagcaaactcgcccctaccacccagcagcgctccgttgttttcccccagactccgtgcagcaggaacttctctcttctggataagtctgggcccattgaatcaggatttaatcaaatcaacgtgaaaaaccagcgagtcctggcaagcccaacttccacaagccagctccactcggagttcagtgactggcatctttggaaatgtgggcagtgctttaagactttcacccagcggatcctcttacagatgcacgtgtgcacgcagaaccccgacaggtaaccctgactctcactgctgacagtgtgtttgcttagtgagacccactgcttgccttcccgccaacttctgagcacctccacaggggaagccctgtgatttgtggtgtctgcattctggaaggtcagagagaaatgcaagaccactgcttgactttcttgcatataagggctgcacagacaggttggtggctgcagagaggaatctgcacttgccttccgaacagttctgcccaagcctaaa

SEQ ID NO: 290198 - DNA, 314 bp, Homo sapiens
tttgggatccccttacaatgcattgcccaggatgaaaactgtaagaatttattttagctctgaattcacatttcaatatacctatttcaaagctaacttttaagagctttttttgaaactcatgaaacgtggttcactgtaataagtaacacaaacatatacaagtctattccatcgttttcttttccctgcatgtcatctgctttctctagggcatcttaacctgtatgggccagtccttcacttatcaacaacttcaaagccttgccagaattttaaataatagttgaagcaagttaagtcagctggtattc

SEQ ID NO: 290199 - DNA, 2637 bp, Homo sapiens
gcacaatctctctctcacacacacacacacacacacacacacacacactcactcactctattttgtgctgtcgtaaaacccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcgctggctggtctctcggccctgccggtgtcgcagctgccggtgttcgcgcctctagccgccgctgccgtcgccgccgagccgctgccccccaaggaactgtgcctcggcgccacctccggccccgggcccgtcaagtgcggtggtggtggcggcggcggcggggagggtcgcggcgccccgcgcttccgctgcagcgcagaggagctggactattacctgtatggccagcagcgcatggagatcatcccgctcaaccagcacaccagcgaccccaacaaccgttgcgacatgtgcgcggacaaccgcaacggcgagtgccctatgcatgggccactgcactcgctgcgccggcttgtgggcaccagcagcgctgcggccgccgcgcccccgccggagctgccggagtggctgcgggacctgcctcgcgaggtgtgcctctgcaccagtactgtgcccggcctggcctacggcatctgcgcggcgcagaggatccagcaaggcacctggattggacctttccaaggcgtgcttctgcccccagagaaggtgcaggcaggcgccgtgaggaacacgcagcatctctgggagatatatgaccaggatgggacactacagcactttattgatggtggggaacctagtaagtcgagctggatgaggtatatccgatgtgcaaggcactgcggagaacagaatctaacagtagttcagtacaggtcgaatatattctaccgagcctgtatagatatccctaggggcaccgagcttctggtgtggtacaatgacagctatacgtctttctttgggatccccttacaatgcattgcccaggatgaaaacttaaatgtcccttcaacggtaatggaagccatgtgcagacaagacgccctgcagcccttcaacaaaagcagcaaactcgcccctaccacccagcagcgctccgttgttttcccccagactccgtgcagcaggaacttctctcttctggataagtctgggcccattgaatcaggatttaatcaaatcaacgtgaaaaaccagcgagtcctggcaagcccaacttccacaagccagctccactcggagttcagtgactggcatctttggaaatgtgggcagtgctttaagactttcacccagcggatcctcttacagatgcacgtgtgcacgcagaaccccgacagaccctaccaatgcggccactgctcccagtccttttcccagccttcagaactgaggaaccacgtggtcactcactctagtgaccggcctttcaagtgcggctactgtggtcgtgcctttgccggggccaccaccctcaacaaccacatccgaacccacactggagaaaagcccttcaagtgcgagaggtgtgagaggagcttcacgcaggccacccagctgagccgacaccagcggatgcccaatgagtgcaagccaataactgagagcccagaatcaatcgaagtggattaacggattgactggttggaattaaactgcaaggaaagtcatgattaaatgtcacggacacttaagcaaaaccaaagatttcctctgagcaactttcaatcagtcccagaaaaccaaaagcagtaataaaataagtaagatgttaagagatattgatcctggcatggaagtcagaccaggaaagagattatttatttatgacttagggatgagacttatttcagtggacaactaacctgggatggtaaacattcccagtcccaccatgtattttgctttgtttctaaaaagctttttaaaaactgttatttaataccaaagggaggaatcgtatgggttcttctgcccaccgttgtgactaagaatgcacagggacttggttctcgttgcacctttttttagtaacatgtttcatggggacccactgtacagcccttcattctgctgtgtcagtttggcctggcctgacactggctgccccagcggggaccacggaagcagagtgagagccttcgctgagtcaatgctaccttcagccccagacgcatcccatttccatgtcttccatgctcactgctcatgcactttttacacggtttcttccaaacagcccggtcttgatgcaggagagtctggaaaaggaagaaaatggtttcagtttcaaaattcaaaggaaaaagttgaggacttattttgtcctgtcaagattgcaagaacatgtaaaatgtacggagcttcataatacgttatattgttccgaagcagctcgttgagaaacatttgttttcaataacattttagcttaaaaaaaaa

SEQ ID NO: 290200 - DNA, 479 bp, Homo sapiens
ataaaacacgagtacgtatgagggtagatgtgtagaagggggtatttccggccgcattctttttttagtaacatgtttcatggggacccactgtacagcccttcattctgctgtgtcagtttggcctggcctgacactggctgccccagcggggaccacggaagcagagtgagagccttcgctgagtcaatgctaccttcagccccagacgcatcccatttccatgtcttccatgctcactgctcatgcactttttacacggtttcttccaaacagcccggtcttgatgcaggagagtctggaaaaggaagaaaatggtttcagtttcaaaattcaaaggaaaaagttgaggacttattttgtcctgtcaagattgcaagaacatgtaaaatgtacggagcttcataatacgttatattgttccgaagcagctcgttgagaaacatttgttttcaataacattttagcttaaaaaaaaa

SEQ ID NO: 290201 - DNA, 2289 bp, Homo sapiens
gcacaatctctctctcacacacacacacacacacacacacacacacactcactcactctattttgtgctgtcgtaaaacccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcgctggctggtctctcggccctgccggtgtcgcagctgccggtgttcgcgcctctagccgccgtgcgggacctgcctcgcgaggtgtgcctctgcaccagtactgtgcccggcctggcctacggcatctgcgcggcgcagaggatccagcaaggcacctggattggacctttccaaggcgtgcttctgcccccagagaaggtgcaggcaggcgccgtgaggaacacgcagcatctctgggagatatatgaccaggatgggacactacagcactttattgatggtggggaacctagtaagtcgagctggatgaggtatatccgatgtgcaaggcactgcggagaacagaatctaacagtagttcagtacaggtcgaatatattctaccgagcctgtatagatatccctaggggcaccgagcttctggtgtggtacaatgacagctatacgtctttctttgggatccccttacaatgcattgcccaggatgaaaacttaaatgtcccttcaacggtaatggaagccatgtgcagacaagacgccctgcagcccttcaacaaaagcagcaaactcgcccctaccacccagcagcgctccgttgttttcccccagactccgtgcagcaggaacttctctcttctggataagtctgggcccattgaatcaggatttaatcaaatcaacgtgaaaaaccagcgagtcctggcaagcccaacttccacaagccagctccactcggagttcagtgactggcatctttggaaatgtgggcagtgctttaagactttcacccagcggatcctcttacagatgcacgtgtgcacgcagaaccccgacagaccctaccaatgcggccactgctcccagtccttttcccagccttcagaactgaggaaccacgtggtcactcactctagtgaccggcctttcaagtgcggctactgtggtcgtgcctttgccggggccaccaccctcaacaaccacatccgaacccacactggagaaaagcccttcaagtgcgagaggtgtgagaggagcttcacgcaggccacccagctgagccgacaccagcggatgcccaatgagtgcaagccaataactgagagcccagaatcaatcgaagtggattaacggattgactggttggaattaaactgcaaggaaagtcatgattaaatgtcacggacacttaagcaaaaccaaagatttcctctgagcaactttcaatcagtcccagaaaaccaaaagcagtaataaaataagtaagatgttaagagatattgatcctggcatggaagtcagaccaggaaagagattatttatttatgacttagggatgagacttatttcagtggacaactaacctgggatggtaaacattcccagtcccaccatgtattttgctttgtttctaaaaagctttttaaaaactgttatttaataccaaagggaggaatcgtatgggttcttctgcccaccgttgtgactaagaatgcacagggacttggttctcgttgcacctttttttagtaacatgtttcatggggacccactgtacagcccttcattctgctgtgtcagtttggcctggcctgacactggctgccccagcggggaccacggaagcagagtgagagccttcgctgagtcaatgctaccttcagccccagacgcatcccatttccatgtcttccatgctcactgctcatgcactttttacacggtttcttccaaacagcccggtcttgatgcaggagagtctggaaaaggaagaaaatggtttcagtttcaaaattcaaaggaaaaagttgaggacttattttgtcctgtcaagattgcaagaacatgtaaaatgtacggagcttcataatacgttatattgttccgaagcagctcgttgagaaacatttgttttcaataacattttagcttaaaaaaaaa

SEQ ID NO: 290202 - DNA, 611 bp, Homo sapiens
caatcctgctggatcaagatgtatatctagtgcagagaaaatctgacaggaacttaaagctaggatatagcagatgatggacttcagggctgagaatactctgctactgatggaaattctgtttaaatgtcactttgcatactacatacacagtgttgggacaagctggaactaaacaacccctctgtggaattaatcatattactgcgtagagcattagacaactgttccattcaaatgttactgatgtcatgtgcaaaatggttgatgggttcacatttggcattcattaagaagtagtggctaaaattagtcagaatcctaggtgattaatctttgatatgcatggccataaatggtgttcagtcacttagccagctttttcatatggatccttcttaaggactggagcatatctcataaaccatttgcttagtcatttaactagagtgcctacttttgccaacagcttgacagtttaaaaaagaataaaagcctgttccctactggaaaaatctggaattttgccataatcgttataggcagtgctctcagtaaattccagctttatgcctcttagacaaacggagtatgaattttactgtcagtag

SEQ ID NO: 290203 - DNA, 475 bp, Homo sapiens
ttatctcactttaccgcccgagaatggcgccagccggggtggggggggctaaagatttggacccagaccgtgccactgccaactgccctcccgcccttgctcccttcccgggctggggccagtgggccctgcctaggggagatgtggacagcgccggcagctcgtgttcgcagtcaccctgaacgccctcctctgaactcccacgtgtctccattctcctaagctcaggtcgtcaaaggcaaacggagaagcccctttaggtcggagagtggtcagtattgcccacccagagctgggagaaaaacgggaaccccaagagaacctcttcccaccaaagcgcagccaccacgccacagatggcgcccttcaacagtgtgtaataccacaacatgctgtaatcgtttactctttacaaatttctttttcacgtactcacaaaatagtacaaattaaaaaaagttacaaaaacgttata

SEQ ID NO: 290204 - DNA, 411 bp, Homo sapiens
cccctccccgccctgccccggcaagccggcggctctacccagcgccgcggtcctggctctggccagacgtgggggaagccggttgcggctgtccctcccgggccgcggttccctagctcccccgcccccgtcccggcaccaccgcaggcccagagcgaggcagcacctgctgggtacgggagtcggcgtgcggcactccaagtccatcatgatgagctgtggaccgtgtgttggggctccccgacggcggccctgttccggctgccgaggcgcggcgcggacagggcggctctggtggcggcggcggcggcggtggcggctgcgtcggcggctcctccgggctccccggcactcggtaatcggctacacgccggcgggcccctgcccgctccgcctcccgccccacaaggg

SEQ ID NO: 290205 - DNA, 607 bp, Homo sapiens
cccctccccgccctgccccggcaagccggcggctctacccagcgccgcggtcctggctctggccagacgtgggggaagccggttgcggctgtccctcccgggccgcggttccctagctcccccgcccccgtcccggcaccaccgcaggcccagagcgaggcagcacctgctgggtacgggagtcggcgtgcggcactccaagtccatcatgatgagctgtggaccgtgtgttggggctccccgacggcggccctgttccggctgccgaggcgcggcgcggacagggcggctctggtggcggcggcggcggcggtggcggctgcgtcggcggctcctccgggctccccggcactcgctcaggtcgtcaaaggcaaacggagaagcccctttaggtcggagagtggtcagtattgcccacccagagctgggagaaaaacgggaaccccaagagaacctcttcccaccaaagcgcagccaccacgccacagatggcgcccttcaacagtgtgtaataccacaacatgctgtaatcgtttactctttacaaatttctttttcacgtactcacaaaatagtacaaattaaaaaaagttacaaaaacgttata

SEQ ID NO: 290206 - DNA, 1070 bp, Homo sapiens
ccagagaggagcaagtgtttcctagagagccctttcttttctccagaagatatggcttttgaaggcataagcagagcccaaaaaaaaggaaagaatacctgctcttgttaggttaagaagaataaaagaagtgctatcacttggctgtagatcttgcaacaagctagaagactctgaagtggacaaaaactccggggatttctgtacagtctgagctctcgtctcctctccgtctggacccacattcacccgaaggcttctcaaaacagctgaggaagggacctccttggaggagttagaatgatttgtagtatcatctagtaaagggaaaataccacagctttatgtagcacctatctctaggagcccaccattttgatacacagcacccaacatctcttggaagctaacatccttatagcaacagacagcattctcattacacaaataaaaactttgtctcacagaagaacagagagatggctttatgttccaaaggcagtcagccaaaacgtgaggaacagaattctctgtcacttggcagtaatggttggtgaataaccaaccattcaacatttggacatcacagaatttagtcctttttgaggccagaaatcagtactttctccttgaaaaatatagctatacaatgaatactaactcaagaataggatctacattttatttttcctggagagagctccctctccttaacttttgtattaggttggtgcaaaagctattgcagtttttgccattacctttttacctatggttgtatctcaggctgcggttattttttctgtgccaccacacctggttaacttttgcatttttagtagagagggtttcaccagccaggctggtctcaaactcctgaccttaagtgatccacccacctcggcctcccaaagtgctgggattataggcatgagccaccacgcccggcctaaatggttacttttttacaatgaaaaatgaggatttcaggtagcttagaaagagagagggagaaaccaacaggacaaaaaaaacaaaaacagagtgacaatccgactttccagatttat

SEQ ID NO: 290207 - DNA, 341 bp, Homo sapiens
tggggcgctgggggaggacgcgtggcctctgtactggatgtgaatgtagtaggtactgtgcgggtgctgcaggacttcctgccagacatgaagcggccgggttcgggacgcgtgttggtgactgggagcatgggaggattgatggggctgcctttcaatgacgtttattgcgccagaaggttcgcgctcgaaggcttatgcgagagtctggcggttctgctgctgcccttgggggtccagtgagtcaacacccccgtctcctcaaccctcagatgggtttgggagggctgtcgagcaataacccgctattcaaatgttctggttatccccagcacaagaac

SEQ ID NO: 290208 - DNA, 485 bp, Homo sapiens
tggggcgctgggggaggacgcgtggcctctgtactggatgtgaatgtagtaggtactgtgcgggtgctgcaggacttcctgccagacatgaagcggccgggttcgggacgcgtgttggtgactgggagcatgggaggattgatggggctgcctttcaatgacgtttattgcgccagaaggttcgcgctcgaaggcttatgcgagagtctggcggttctgctgctgcccttgggggtccagtgagtcaacacccccgtctcctcaaccctcttaactctgacctagagatgccgagcaccctgtcctgcggaagccgctctggtctctgcccggcttacatttgctgcgtgccaggcacttaggctggagcattggcacgcattgtgccacttgctgacctggctgctgaagtgttggtattgttatggggaagctccagccaagagaggttaggtgactggcccaaggtcatgcagcggccgggg

SEQ ID NO: 290209 - DNA, 461 bp, Homo sapiens
caattaactctattagtttggtggtggtggtggtggtggttgttgttttgagatagggtctcagtcttcacccagactggagtgccatggcgtgaccacagctcactgcagccttgaccttctgggttcaagtaatcctctctccttggcctcctaagtagctgagactacaggcatctgccgctgtgcctggccaattttttacatttttctgtagagacagggtctcattatgttgccgaggcttgtcttgaactcctgggctcaagcagtccttctatctcggcttcccagagtgttggggttacaggcgtgagccaccacattcagcctaactcttattagttctacattgctaccatgataatctggaagcctgaaaatagtctgttttttgagacttccctgagcaaacatgactatgaagagcactactttcctccttttcctttgcaggtgtt

SEQ ID NO: 290210 - DNA, 663 bp, Homo sapiens
ttttggctcttgccacccaaatcctgactggatgtgatgaagtgttggaaatgctacagcaggtcacaactgccctcataaatagtgacatagcagaccgtgagcagaggtgaggaatggattgtgggctgtgaccagctgccctgtgggaagaaaagtttgtttattgaaattaaatctttttagaatatagaaggatcaattttatatagagagatttttgtgagaataggctaaaagggcaagtgtttgaaagccaagtgcagtcacactctttcatgtgctttcaggtgagattgggccaacagccatgatctaagggtagcgaggttgtggagggcacagcctaatctctgccacttgagacttctactgccatcactcccaaaatggcctttcctttaattatcaaggtcagcaccatgcacacttagtttcctcatgataaagacttttgggaggaagaagtgacttaccaactgctacacaaaggatgacactgatgtggtacctcaagattttactgtaattttacttctccaaatacatggctgacctatatagagggcagacttctctttcacagtaataaagccctttctcagcctttcacattaaaatttctgctgtaaccccatctctactaaaaatacaaaaaaaaaa

SEQ ID NO: 290211 - DNA, 472 bp, Homo sapiens
ttttggctcttgccacccaaatcctgactggatgtgatgaagtgttggaaatgctacagcaggtcacaactgccctcataaatagtgacatagcagaccgtgagcagaggttaaaaggcttggaacaagttactaaggctactatgcttggtcaccttcttccagtgttactgacctccttgatgcatccaaatttacagactctgatcatggcggatgccctgatgcctcagctagtgcagctggtactctataccagccagacggcgttgctgcttaaaacccagtgtccggtttttgctgaggtgggctgttccccgtgtggtgcaccagaccagaagtgcaggctgttccctgatgagaggtaatgaatgctgcttccttgcaggaacccttttcttgttttctttgggtgaaagcgtagtactccttttatgaaaatgatttttagcaaggattatctagctgtgaa

SEQ ID NO: 290212 - DNA, 572 bp, Homo sapiens
gcggccgcggcgcccgccctcgcccgcgccccatggggtcacagagtctgtagaagaggcgacaccagggcttccaaatgaacaaccgaaaggaagatatggaaatcacgtcccactaccggcacctgctgcgggagctcaacgagcagaggcagcacggcgtcctgtgcgacgtctgcgtggtcgtggagggcaaggtcttcaaggcgcacaagaacgtcctgctgggcagcagccgctacttcaagacgctctactgccaggtgcagaagacgtcggagcaggccacggtcacgcacctggacatcgtcacggcccagggcttcaaggccatcatcgacttcatgtactcagcgcacctggcgctcaccagcaggaacgtcatcgaggtgatgtcagccgccagcttcctgcagatgacggacatcgtgcaagcctgccacgacttcatcaaggcggcgctggacatcagcatcaagtcggacgcctcagatgagcttgcggagttcgagatcggcgcctcgtccagcagcagcacggaagctctcatctcggccgtgatggctgggagg

SEQ ID NO: 290213 - DNA, 764 bp, Homo sapiens
ctctaaagaagtgctgctcactagaaatacattgtgagccaaaaagatgagccacatagagcttctcggcttagcggctgaagactgacactgccagatcgcctcggaagccccctagaccatcacggatgccgagcttcgggtaactctcacagtggaggacaacttccatcttcaccatgagctgggaggcaggaggataatctggcttcaggaaggaagaaaatgtttgtagttctgggaactccagctcatttttaccactgcctgacagcctccacagcagggtttgtttgaaccccaagggaaggatatctcagcagcttcagggagtgactgcgtactttggtgaaaagccccagcgagctcttggtttaagctaaaaggtccagcacgcccactacaaaatccttgcattgcatagataacttcctgtaatcgttctaacagaatagagagaaatcagcggtatgtcacatggaggcccgcagattggcttgcccagcatagcagtgtcgatcagcaactgctcaccacatgtgaccttatggagcacattggatgcacttatggaacgcagcaggatgtgctgggtgcagaaggcggggcaatttctcttgacacgtgacctgaaggacattttctctaggtcagcatgtgtgaaggtgtggtccatgggccacctgcatcagagtcaccttagctgcgtgctaaagttgcagattcccaggtcccaccctagacttactgagtcagaatacctg

SEQ ID NO: 290214 - DNA, 441 bp, Homo sapiens
gagaccaaaatagggtccaacgcatcctgagacctcgagctggtaacgtacagggaaggtgaacagtgagtcagcccttccttccgctaagtcaacatagtggccttattcccaccactccaggctgggaaaggacaaacatacaagaaatgcttttaatcacggaataagactaagcctcaagccccctcatctgccaaagagtgtgctctgctgtcaaacctcaaagtcattgagaaacaaaccctgataatctcacccagcttcaagaccaagggagtcctagtgtcatggagaagagcaaggaggggcccagggctgccgaagatagatgtctaccaactaggaagagagccctcaccaggaaccaaatctgctgacacctggatcttgaacttcccagccaacagaattgtgaggaataaatgtatgtattttaag

SEQ ID NO: 290215 - DNA, 538 bp, Homo sapiens
gagaccaaaatagggtccaacgcatcctgagacctcgagctggtaacgtacagggaaggtgaacagtgagtcagcccttccttccgctaagtcaacatagtggccttattcccaccactccaggctgggaaaggacaaacatacaagaaatgcttttaatcacggaataagactaagcctcaagccccctcatctgccaaagagtgtgctctgctgtcaaacctcaaagtcattgagaaacaaaccctgataatctcacccagcttcaagaccaagggagtcctagtgtcatggagaagagcaaggaggggcccagggctgccgcaggacatgccactccagacagaactcaacttccctagtgactattggctatccaacctctcctccagcacagcaagcagatgacaatacttgcaagacatgatgtgttaaattaaaaaacatagtctatttaacaaattcttttataaatttttctggattctctggccaaatttttccttgtataaaactaaatcacacatagaaaatggca

SEQ ID NO: 290216 - DNA, 1169 bp, Homo sapiens
caacctggcatttaggtggtgtgggaacaggagaccccagactttcttgttttggggtctggggcaggcaaccaggctccagggacagtgagttgaaggaagggtggctgggagaccccttgacttgctgccaaggagacagagctggagctagggtggccggtggtgtctgaggcaggtgcagagagggagggagggaaggggcctttgactccaacctcctttttctgtaccgactgcaggtggcagctgccctttcaggagccagtgggggaacctgggtggctgggtggggacacctgcaagtcctccctaagccagctaccaccctacactgttggcctcccttctccaactgtggggatgctgctcaggccttttgtgacatcacacctgagagtccctggggtccagtcattgctgctgggcacagcgaggtccaagctcaggtcgccctgccccctacccaccatgccagatccagcatcgttgtgggcaaacaattatctggatgatctttatggggcttaagcttgggtgggagcagatggggcatgagctggggatttggggatggggggaatccacacccccacgtcctggacgtttaaaaggccctctctggcactgggccggggcagaggccagcagaaaagtgactggagtccagggacatgatggatcaggaggagaagacggaggaaggctcaggcccctgtgccgaggcgggctccccagaccaggagggcttcttcaatctgctgagccacgtgcagggcgaccggatggagggacagcgctgttcactgcaagccgggccgggccagaccaccaagagcctctgtgaacgtccacgcagagagcgaccccacccccgagatggacagcctcatggacatgctggccagtacccagggccgccgcatggatgaccaacgtgtgacagtcagcagcctgcccggcttccagcccgtggggtccaaggacggagcacagaaacgagctgggaccctcagtccccaacccctgctcacccctcaggacccgaccgctctcggcttccgtcggaacagcagcccccagcccccgacacaagccccctgagggcctgaggcatcctgggtctcactcggcccccaaaaactgataaaagaataaaacacttaaat

SEQ ID NO: 290217 - DNA, 1108 bp, Homo sapiens
gcacgaagtcgctggaggtgcacacctcgacgacacgctcacagatgggagttcagacacacacttcctggcttgcgtgcgaagcaggatcgcagggcaataatccctccatcttccccgggaggttctgtgcctgcaagatacacggcacccactcgatgccaccgggccgccactgtctgggcctgggatcttgacccacttgccttctgtacttcagggtttagaggcagcagcagcagcagcagccgtcttggataacttttgatggattcaggaggcctggagacctcttgtgtgcaggcacctggacataattttcattcagtcctgcccaatgttccgacctggactgcggtgccgacgaggaaaccgaggcttagcgggatccctaatccaaggccacgacgagtgagcctgctgggttcaagccaggagcctgtccccagggggcatttgtcacagccttaccctcttccgggaggcgcaacgcttaccctcgtggaccaacaatcgaattaacatgctgatacacacatggggtgagtgacgccctcaaatgcttgcaaacacagacacacactcggaatttcagaagctgcttctgctgtgtgtcctgtcgcttggaaggcacagccccagcagcacccatacaaaatgaggtctccgatttaaggtgcgaggcgggctccccagaccaggagggcttcttcaatctgctgagccacgtgcagggcgaccggatggagggacagcgctgttcactgcaagccgggccgggccagaccaccaagagccagagcgaccccacccccgagatggacagcctcatggacatgctggccagtacccagggccgccgcatggatgaccaacgtgtgacagtcagcagcctgcccggcttccagcccgtggggtccaaggacggagcacagaaacgagctgggaccctcagtccccaacccctgctcacccctcaggacccgaccgctctcggcttccgtcggaacagcagcccccagcccccgacacaagccccctgagggcctgaggcatcctgggtctcactcggcccccaaaaactgataaaagaataaaacacttaaat

SEQ ID NO: 290218 - DNA, 153 bp, Homo sapiens
gggctccccagaccaggagggcttcttcaatctgctgagccacgtgcagggcgaccggatggagggacagcgctgttcactgcaagccgggccgggccagaccaccaagagccgtgagcatgggcacgggggtgctgtccatggggcgtgaac

SEQ ID NO: 290219 - DNA, 1150 bp, Homo sapiens
caacctggcatttaggtggtgtgggaacaggagaccccagactttcttgttttggggtctggggcaggcaaccaggctccagggacagtgagttgaaggaagggtggctgggagaccccttgacttgctgccaaggagacagagctggagctagggtggccggtggtgtctgaggcaggtgcagagagggagggagggaaggggcctttgactccaacctcctttttctgtaccgactgcaggtggcagctgccctttcaggagccagtgggggaacctgggtggctgggtggggacacctgcaagtcctccctaagccagctaccaccctacactgttggcctcccttctccaactgtggggatgctgctcaggccttttgtgacatcacacctgagagtccctggggtccagtcattgctgctgggcacagcgaggtccaagctcaggtcgccctgccccctacccaccatgccagatccagcatcgttgtgggcaaacaattatctggatgatctttatggggcttaagcttgggtgggagcagatggggcatgagctggggatttggggatggggggaatccacacccccacgtcctggacgtttaaaaggccctctctggcactgggccggggcagaggccagcagaaaagtgactggagtccagggacatgatggatcaggaggagaagacggaggaaggctcaggcccctgtgccgaggcgggctccccagaccaggagggcttcttcaatctgctgagccacgtgcagggcgaccggatggagggacagcgctgttcactgcaagccgggccgggccagaccaccaagagccagagcgaccccacccccgagatggacagcctcatggacatgctggccagtacccagggccgccgcatggatgaccaacgtgtgacagtcagcagcctgcccggcttccagcccgtggggtccaaggacggagcacagaaacgagctgggaccctcagtccccaacccctgctcacccctcaggacccgaccgctctcggcttccgtcggaacagcagcccccagcccccgacacaagccccctgagggcctgaggcatcctgggtctcactcggcccccaaaaactgataaaagaataaaacacttaaat

SEQ ID NO: 290220 - DNA, 874 bp, Homo sapiens
gcacgaagtcgctggaggtgcacacctcgacgacacgctcacagatgggagttcagacacacacttcctggcttgcgtgcgaagcaggatcgcagggcaataatccctccatcttccccgggaggttctgtgcctgcaagatacacggcacccactcgatgccaccgggccgccactgtctgggcctgggatcttgacccacttgccttctgtacttcagggtttagaggcagcagcagcagcagcagccgtcttggataacttttgatggattcaggaggcctggagacctcttgtgtgcaggcacctggacataattttcattcagtcctgcccaatgttccgacctggactgcggtgccgacgaggaaaccgaggcttagcgggatccctaatccaaggccacgacgagtgagcctgctgggttcaagccaggagcctgtccccagggggcatttgtcacagccttaccctcttccgggaggcgcaacgcttaccctcgtggaccaacaatcgaattaacatgctgatacacacatggggtgagtgacgccctcaaatgcttgcaaacacagacacacactcggaatttcagaagctgcttctgctgtgtgtcctgtcgcttggaaggcacagccccagcagcacccatacaaaatgaggtctccgatttaaggtgcgaggtatgtgtgcaaacagactcttgctggtctgagctggttccttcgctcggccgtgttgatgaaggtaccaagccccctgccacttacatgggacatagggagtgaatcagacccgaaggtctgggggagataggaaaggatccatgctgccctaaaggaaataaactaatgtgacaacaagtgccacagaa

SEQ ID NO: 290221 - DNA, 2182 bp, Homo sapiens
tccccacacattcacacacccactcccaatatacagtatctcgcccaatgtttatcactccggatacattcctagaatccaaagatctggagcagggagaaaaagaaaaggcgcctaccagatgcctggaacagtctactaggcactacaagtacattagctctttcaatgctcacaacagcccagccagatgttatctcaatcttacggatgaataaatttaagacttctggctggacactagaggctggcgaagtacgtgacctttgatcagaatctcctggaggagtggggtccctgaccattgtaccttccagagaaccttaaaactgagatcccaggagacccctctcggatactctgcagaagtcagagtgacgatattagcaagcacaccgcagccatgcgaacccttcctggctcagctcccgacaaaagaaatcaagcccccagtcaaaatacaacaacaacggattaggcctacaaccctctcccccggcccccaaattctcaggagaaatcccctaagagtcaggtacggaggtcactgcagcgacttcagcgtgcagagaacgcggggacctaggaagaggacgctccagcccaactgagcgtctctgattggccgccagctcagcttggaacgctggggtgcgtggcgtcatatccgccgggcccgccatcttgttcccaggggcagttggcggaagagatcgagctccctggctgccggctcgccttctgcgtggagttctcgcggtctgggtttcgctgtctgctcttggcccggggtcattttgtcggcgtcgggtgccctctcttgcccagctggggcacagcgaggcggccccttctcccgacgacgttcgatggagtagggtcccagaccgttgtcccgaagagcgagatcgagcttggccccctcccccccctccttccctccctccttccttccgccgcaacatggctaacaacagccccgcgctgacaggcaactcgcagccgcagcaccaggcggctgcagctgcggctcagcaacagcagcagtgcggcggcggcggcgctaccaagccggcggtctccggcaagcagggcaatgtgctcccgctctggggcaacgagaagaccatgaacctcaaccccatgatcctgaccaacatcctgtcgtcgccttacttcaaagtacagctctacgagctcaagacctaccacgaggtggtggacgagatctactttaaggtcacgcacgttgaaccatgggagaaaggaagcaggaaaacagcgggccagacagggatgtgcggaggggttcgaggtgttggaacaggaggaattgtttctacagcattttgcctgttatacaaattatttaccctgaagttaactcgaaagcaagtgatgggtcttataacacacacagactctccatatattagagcgcttggatttatgtatataagatatacacagccccctacagatctgtgggactggtttgaatccttccttgatgatgaagaggtatgtcaacaagggtaataatttgttttcttctgattactctcatatttttattatcttttatttattggtggtttaatgtcttcaagaacttcctgtagttaaatttatttcagtgagatacttttggaattaatgtccttttactgagacctgatggcttttatgtattttagggtaaatttctgaagttttattttcttgttttaaaattgtttaaatgtgtttggtaactattggaaaattttctcttcttaattatgttctgtgtattgtattgatcctgaattgtatagttaatagtgacttttcaagatggggcatgctcaagatcgaacagataataaaagatatgcacatagaatactaattgtagcttttttttcttctggaacatttcagttcttcaccctctagcttcttccaaatatcagtattcccacttgcatagaagtgcagaattgaagagttgggtgttacataaataggctaagtgtttggatgacttgttcaaggtgacaaaattttaattccagttttctgactcctagtacaccacacacacctttaaaaaagaaattttttaaattgtaattcgagtctccctaatttgaaatctgaaatactaagttagatttaaatcgtgtatgcattggctggg

SEQ ID NO: 290222 - DNA, 4390 bp, Homo sapiens
tccccacacattcacacacccactcccaatatacagtatctcgcccaatgtttatcactccggatacattcctagaatccaaagatctggagcagggagaaaaagaaaaggcgcctaccagatgcctggaacagtctactaggcactacaagtacattagctctttcaatgctcacaacagcccagccagatgttatctcaatcttacggatgaataaatttaagacttctggctggacactagaggctggcgaagtacgtgacctttgatcagaatctcctggaggagtggggtccctgaccattgtaccttccagagaaccttaaaactgagatcccaggagacccctctcggatactctgcagaagtcagagtgacgatattagcaagcacaccgcagccatgcgaacccttcctggctcagctcccgacaaaagaaatcaagcccccagtcaaaatacaacaacaacggattaggcctacaaccctctcccccggcccccaaattctcaggagaaatcccctaagagtcaggtacggaggtcactgcagcgacttcagcgtgcagagaacgcggggacctaggaagaggacgctccagcccaactgagcgtctctgattggccgccagctcagcttggaacgctggggtgcgtggcgtcatatccgccgggcccgccatcttgttcccaggggcagttggcggaagagatcgagctccctggctgccggctcgccttctgcgtggagttctcgcggtctgggtttcgctgtctgctcttggcccggggtcattttgtcggcgtcgggtgccctctcttgcccagctggggcacagcgaggcggccccttctcccgacgacgttcgatggagtagggtcccagaccgttgtcccgaagagcgagatcgagcttggccccctcccccccctccttccctccctccttccttccgccgcaacatggctaacaacagccccgcgctgacaggcaactcgcagccgcagcaccaggcggctgcagctgcggctcagcaacagcagcagtgcggcggcggcggcgctaccaagccggcggtctccggcaagcagggcaatgtgctcccgctctggggcaacgagaagaccatgaacctcaaccccatgatcctgaccaacatcctgtcgtcgccttacttcaaagtacagctctacgagctcaagacctaccacgaggtggtggacgagatctactttaaggtcacgcacgttgaaccatgggagaaaggaagcaggaaaacagcgggccagacagggatgtgcggaggggttcgaggtgttggaacaggaggaattgtttctacagcattttgcctgttatacaaattatttaccctgaagttaactcgaaagcaagtgatgggtcttataacacacacagactctccatatattagagcgcttggatttatgtatataagatatacacagccccctacagatctgtgggactggtttgaatccttccttgatgatgaagaggacctagatgtgaaggctggtggaggctgtgtaatgaccattggagaaatgctacgatcttttctcacaaaactggagtggttttctaccttgtttccaagaattccagttccagttcaaaagaatattgatcaacagattaaaacccgacctagaaaaatcaagaaagatgggaaggaaggtgctgaggaaatagacagacatgttgaacgcagacgttcaaggtctccaaggagatctctgagtccacggaggtccccaagaaggtcaagaagtagaagtcatcatcgggagggccatgggtcttctagttttgacagagaattagaaagagagaaagaacgccagcgactagagcgtgaagccaaagaaagggagaaagaacggcgaagatcccgaagtattgaccgggggttagaacgcaggcgcagcagaagtagggaaaggcatagaagtcgcagtcgaagtcgtgataggaaaggggatagaagggacagggatcgagaaagagagaaagaaaatgagagaggtagaagacgagatcgtgactatgataaggaaagaggaaatgaacgagaaaaagagagagagcgatcaagagaaaggtccaaggaacagagaagtaggggagaggtagaagagaagaaacataaagaagacaaagatgataggcggcacagagatgacaaaagagattccaagaaagagaaaaaacacagtagaagcagaagcagagaaaggaaacacagaagtaggagtcgaagtagaaatgcagggaaacgaagtagaagtagaagcaaagagaaatcaagtaaacataaaaatgaaagtaaagaaaaatcaaataaacgaagtcgaagtggcagtcaaggaagaactgacagtgttgaaaaatcaaaaaaacgggaacatagtcccagcaaagaaaaatctagaaagcgtagtagaagcaaagaacgttcccacaaacgagatcacagtgatagtaaggaccagtcagacaaacatgatcgtcgaaggagccaaagtatagaacaagagagccaagaaaaacagcataaaaacaaagatgagactgtgtgaaaatattttgtaaaagtggatcacattgaatcctataaatgattaaatctgcttttttcccccacgttgagattgtgcagtagttcgcactcctcaagctctccctgtaggctgcattttcatttcctctttcgtgtagggaagtgcctttgtaattccatttattgcattggtgttttcacccaattgttaagtttgatacatgatgcacagattgttcttgcatttttattgtttgtttttgaaatgtacagtctgtacatatgtcctgaaaatgttttaattcctttggcatggttgccatgttggttaaatttgtataaggcaataaactgccactaatctatttttgttttgtaggtgtgggattatggtttgtgtactgaagttagcatggctgtgcttttcgtaatagaatgctaaagactttgagaatggatcttggatgtctattataggagaagtatgtgctgccaatgtacaagaaggcagcattgtaggattaacattcttgtctactgtatattatcttggaaggctcttgttaatatgttacacttaatattctccacagttacctttagagagaatttatgagaagttagtttctgatgcagaggtttttaggctgtgatttcatcaaaagtccttttagcattctacctcaaagggacacttagtatgcctaaaatttattcacttagttttccttttttatttgaaaaaatacatgacatgtaatctttttttcttgaattctttctcagattttaaagtactatattaaagaaaaaaattaatgtctaaagcctagcattcttgcagaaccctatactaacatgtaatggggagagggtggggcagatgagtagagaaacagattcaagcctcaagcttccaaagcatttttataaatggaaaatccttaaattatgaaacagcttgatatagtgtcctttttttaaaattcagaactttttttattgataatggagattgctgtttgagtttttaaacttaatctagaacagaggagtattaaaagtaatgctgtgctgcattatttaagactatcagcaaattatttgatagattgttcttacaacttgtattctgattacagaaccatcatgagtgtggaataaatactggattaaatcctttatcctgggtcttggcttttcccccatttgttaaatttttttagcatatttatattgtggaaattgatgaaacgtcagtagagtcacactttgtgtacagggatgtcttagtgcccagatgacaagtgaattttggagaaatgcatagactgggattgggcatgtggtaatcaataatctttattagaatacttgataatggcagttccctttgtcagtggttgttacatgtgtcatttgattactttgttccatgtcaaagacgtttattgggataccttttacttggacaatatgttagcattttttaaaatttggacttgaaattctttaagataattcacccaattctttttagaaaagaaaatagaggcccaaagtaatgatgtcagtgctagggctaaaactcagtattctgacagtgtagtgaacctggcacgcacattgaggtttgttttatctcactggttatactggccaactaatgcgcactcagaagccaccttgcaaaaatgttaaatggagcaaacgagtacacttgcaagagtcctccatatgtgggcttaacatatgtaccactccattttagaaaaatctcattaaatgaattcttctaaaaatga

SEQ ID NO: 290223 - DNA, 2590 bp, Homo sapiens
tggtcatctctaggagtcgagctgctaggagtgcaagctatgagactgagcgtcaataaagaacgccagcgactagagcgtgaagccaaagaaagggagaaagaacggcgaagatcccgaagtattgaccgggggttagaacgcaggcgcagcagaagtagggaaaggcatagaagtcgcagtcgaagtcgtgataggaaaggggatagaagggacagggatcgagaaagagagaaagaaaatgagagaggtagaagacgagatcgtgactatgataaggaaagaggaaatgaacgagaaaaagagagagagcgatcaagagaaaggtccaaggaacagagaagtaggggagaggtagaagagaagaaacataaagaagacaaagatgataggcggcacagagatgacaaaagagattccaagaaagagaaaaaacacagtagaagcagaagcagagaaaggaaacacagaagtaggagtcgaagtagaaatgcagggaaacgaagtagaagtagaagcaaagagaaatcaagtaaacataaaaatgaaagtaaagaaaaatcaaataaacgaagtcgaagtggcagtcaaggaagaactgacagtgttgaaaaatcaaaaaaacgggaacatagtcccagcaaagaaaaatctagaaagcgtagtagaagcaaagaacgttcccacaaacgagatcacagtgatagtaaggaccagtcagacaaacatgatcgtcgaaggagccaaagtatagaacaagagagccaagaaaaacagcataaaaacaaagatgagactgtgtgaaaatattttgtaaaagtggatcacattgaatcctataaatgattaaatctgcttttttcccccacgttgagattgtgcagtagttcgcactcctcaagctctccctgtaggctgcattttcatttcctctttcgtgtagggaagtgcctttgtaattccatttattgcattggtgttttcacccaattgttaagtttgatacatgatgcacagattgttcttgcatttttattgtttgtttttgaaatgtacagtctgtacatatgtcctgaaaatgttttaattcctttggcatggttgccatgttggttaaatttgtataaggcaataaactgccactaatctatttttgttttgtaggtgtgggattatggtttgtgtactgaagttagcatggctgtgcttttcgtaatagaatgctaaagactttgagaatggatcttggatgtctattataggagaagtatgtgctgccaatgtacaagaaggcagcattgtaggattaacattcttgtctactgtatattatcttggaaggctcttgttaatatgttacacttaatattctccacagttacctttagagagaatttatgagaagttagtttctgatgcagaggtttttaggctgtgatttcatcaaaagtccttttagcattctacctcaaagggacacttagtatgcctaaaatttattcacttagttttccttttttatttgaaaaaatacatgacatgtaatctttttttcttgaattctttctcagattttaaagtactatattaaagaaaaaaattaatgtctaaagcctagcattcttgcagaaccctatactaacatgtaatggggagagggtggggcagatgagtagagaaacagattcaagcctcaagcttccaaagcatttttataaatggaaaatccttaaattatgaaacagcttgatatagtgtcctttttttaaaattcagaactttttttattgataatggagattgctgtttgagtttttaaacttaatctagaacagaggagtattaaaagtaatgctgtgctgcattatttaagactatcagcaaattatttgatagattgttcttacaacttgtattctgattacagaaccatcatgagtgtggaataaatactggattaaatcctttatcctgggtcttggcttttcccccatttgttaaatttttttagcatatttatattgtggaaattgatgaaacgtcagtagagtcacactttgtgtacagggatgtcttagtgcccagatgacaagtgaattttggagaaatgcatagactgggattgggcatgtggtaatcaataatctttattagaatacttgataatggcagttccctttgtcagtggttgttacatgtgtcatttgattactttgttccatgtcaaagacgtttattgggataccttttacttggacaatatgttagcattttttaaaatttggacttgaaattctttaagataattcacccaattctttttagaaaagaaaatagaggcccaaagtaatgatgtcagtgctagggctaaaactcagtattctgacagtgtagtgaacctggcacgcacattgaggtttgttttatctcactggttatactggccaactaatgcgcactcagaagccaccttgcaaaaatgttaaatggagcaaacgagtacacttgcaagagtcctccatatgtgggcttaacatatgtaccactccattttagaaaaatctcattaaatgaattcttctaaaaatga

SEQ ID NO: 290224 - DNA, 2529 bp, Homo sapiens
tccccacacattcacacacccactcccaatatacagtatctcgcccaatgtttatcactccggatacattcctagaatccaaagatctggagcagggagaaaaagaaaaggcgcctaccagatgcctggaacagtctactaggcactacaagtacattagctctttcaatgctcacaacagcccagccagatgttatctcaatcttacggatgaataaatttaagacttctggctggacactagaggctggcgaagtacgtgacctttgatcagaatctcctggaggagtggggtccctgaccattgtaccttccagagaaccttaaaactgagatcccaggagacccctctcggatactctgcagaagtcagagtgacgatattagcaagcacaccgcagccatgcgaacccttcctggctcagctcccgacaaaagaaatcaagcccccagtcaaaatacaacaacaacggattaggcctacaaccctctcccccggcccccaaattctcaggagaaatcccctaagagtcaggtacggaggtcactgcagcgacttcagcgtgcagagaacgcggggacctaggaagaggacgctccagcccaactgagcgtctctgattggccgccagctcagcttggaacgctggggtgcgtggcgtcatatccgccgggcccgccatcttgttcccaggggcagttggcggaagagatcgagctccctggctgccggctcgccttctgcgtggagttctcgcggtctgggtttcgctgtctgctcttggcccggggtcattttgtcggcgtcgggtgccctctcttgcccagctggggcacagcgaggcggccccttctcccgacgacgttcgatggagtagggtcccagaccgttgtcccgaagagcgagatcgagcttggccccctcccccccctccttccctccctccttccttccgccgcaacatggctaacaacagccccgcgctgacaggcaactcgcagccgcagcaccaggcggctgcagctgcggctcagcaacagcagcagtgcggcggcggcggcgctaccaagccggcggtctccggcaagcagggcaatgtgctcccgctctggggcaacgagaagaccatgaacctcaaccccatgatcctgaccaacatcctgtcgtcgccttacttcaaagtacagctctacgagctcaagacctaccacgaggtggtggacgagatctactttaaggtcacgcacgttgaaccatgggagaaaggaagcaggaaaacagcgggccagacagggatgtgcggaggggttcgaggtgttggaacaggaggaattgtttctacagcattttgcctgttatacaaattatttaccctgaagttaactcgaaagcaagtgatgggtcttataacacacacagactctccatatattagagcgcttggatttatgtatataagatatacacagccccctacagatctgtgggactggtttgaatccttccttgatgatgaagaggacctagatgtgaaggctggtggaggctgtgtaatgaccattggagaaatgctacgatcttttctcacaaaactggagtggttttctaccttgtttccaagaattccagttccagttcaaaagaatattgatcaacagattaaaacccgacctagaaaaatcaagaaagatgggaaggaaggtgctgaggaaatagacagacatgttgaacgcagacgttcaaggtctccaaggagatctctgagtccacggaggtccccaagaaggtcaagaagtagaagtcatcatcgggagggccatgggtcttctagttttgacagagaattagaaagagagaaagaacgccagcgactagagcgtgaagccaaagaaagggagaaagaacggcgaagatcccgaagtattgaccgggggttagaacgcaggcgcagcagaagtagggaaaggcatagaagtcgcagtcgaagtcgtgataggaaaggggatagaagggacagggatcgagaaagagagaaagaaaatgagagaggtagaagacgagatcgtgactatgataaggaaagaggaaatgaacgagaaaaagagagagagcgatcaagagaaaggtccaaggaacagagaagtaggggagaggtagaagagaagaaacataaagaagacaaagatgataggcggcacagagatgacaaaagagattccaagaaagagaaaaaacacagtagaagcagaagcagagaaaggaaacacagaagtaggagtcgaagtagaaatgcagggaaacgaagtagaagtagaagcaaagagaaatcaagtaagatgggaaggaaggtgctgaggaaatagacagacatgttgaacgcagacgttcaaggtctccaaggagatctctgagtccacggaggtccccaagaaggtcaagaagtagaagtcatcatcgggagggccatgggtcttctagttttgacagagaattagaaagagagaaagaaaaaaaatgtcgcgcggccg

SEQ ID NO: 290225 - DNA, 1307 bp, Homo sapiens
  misc_feature (1282)..(1282): n is a, c, g, or t
tccccacacattcacacacccactcccaatatacagtatctcgcccaatgtttatcactccggatacattcctagaatccaaagatctggagcagggagaaaaagaaaaggcgcctaccagatgcctggaacagtctactaggcactacaagtacattagctctttcaatgctcacaacagcccagccagatgttatctcaatcttacggatgaataaatttaagacttctggctggacactagaggctggcgaagtacgtgacctttgatcagaatctcctggaggagtggggtccctgaccattgtaccttccagagaaccttaaaactgagatcccaggagacccctctcggatactctgcagaagtcagagtgacgatattagcaagcacaccgcagccatgcgaacccttcctggctcagctcccgacaaaagaaatcaagcccccagtcaaaatacaacaacaacggattaggcctacaaccctctcccccggcccccaaattctcaggagaaatcccctaagagtcaggtacggaggtcactgcagcgacttcagcgtgcagagaacgcggggacctaggaagaggacgctccagcccaactgagcgtctctgattggccgccagctcagcttggaacgctggggtgcgtggcgtcatatccgccgggcccgccatcttgttcccaggggcagttggcggaagagatcgagctccctggctgccggctcgccttctgcgtggagttctcgcggtctgggtttcgctgtctgctcttggcccggggtcattttgtcggcgtcgggtgccctctcttgcccagctggggcacagcgaggcggccccttctcccgacgacgttcgatggagtagggtcccagaccgttgtcccgaagagcgagatcgagcttggccccctcccccccctccttccctccctccttccttccgccgcaacatggctaacaacagccccgcgctgacaggcaactcgcagccgcagcaccaggcggctgcagctgcggctcagcaacagcagcagtgcggcggcggcggcgctaccaagccggcggtctccggcaagcagggcaatgtgctcccgctctggggcaacgagaagaccatgaacctcaaccccatgatcctgaccaacatcctgtcgtcgccttacttcaaagtacagctctacgagctcaagacctaccacgaggtggtggacgagatctactttaaggtcacgctacgtgaaccatgggagaaaggaagcagggaaatgntctacagcattttgcctggtataca

SEQ ID NO: 290226 - DNA, 2929 bp, Homo sapiens
aagctttacgctatggaaatactttttttgacggctagggtatcttttgtgtttctgtaggacctagatgtgaaggctggtggaggctgtgtaatgaccattggagaaatgctacgatcttttctcacaaaactggagtggttttctaccttgtttccaagaattccagttccagttcaaaagaatattgatcaacagattaaaacccgacctagaaaaatcaagaaagatgggaaggaaggtgctgaggaaatagacagacatgttgaacgcagacgttcaaggtctccaaggagatctctgagtccacggaggtccccaagaaggtcaagaagtagaagtcatcatcgggagggccatgggtcttctagttttgacagagaattagaaagagagaaagaacgccagcgactagagcgtgaagccaaagaaagggagaaagaacggcgaagatcccgaagtattgaccgggggttagaacgcaggcgcagcagaagtagggaaaggcatagaagtcgcagtcgaagtcgtgataggaaaggggatagaagggacagggatcgagaaagagagaaagaaaatgagagaggtagaagacgagatcgtgactatgataaggaaagaggaaatgaacgagaaaaagagagagagcgatcaagagaaaggtccaaggaacagagaagtaggggagaggtagaagagaagaaacataaagaagacaaagatgataggcggcacagagatgacaaaagagattccaagaaagagaaaaaacacagtagaagcagaagcagagaaaggaaacacagaagtaggagtcgaagtagaaatgcagggaaacgaagtagaagtagaagcaaagagaaatcaagtaaacataaaaatgaaagtaaagaaaaatcaaataaacgaagtcgaagtggcagtcaaggaagaactgacagtgttgaaaaatcaaaaaaacgggaacatagtcccagcaaagaaaaatctagaaagcgtagtagaagcaaagaacgttcccacaaacgagatcacagtgatagtaaggaccagtcagacaaacatgatcgtcgaaggagccaaagtatagaacaagagagccaagaaaaacagcataaaaacaaagatgagactgtgtgaaaatattttgtaaaagtggatcacattgaatcctataaatgattaaatctgcttttttcccccacgttgagattgtgcagtagttcgcactcctcaagctctccctgtaggctgcattttcatttcctctttcgtgtagggaagtgcctttgtaattccatttattgcattggtgttttcacccaattgttaagtttgatacatgatgcacagattgttcttgcatttttattgtttgtttttgaaatgtacagtctgtacatatgtcctgaaaatgttttaattcctttggcatggttgccatgttggttaaatttgtataaggcaataaactgccactaatctatttttgttttgtaggtgtgggattatggtttgtgtactgaagttagcatggctgtgcttttcgtaatagaatgctaaagactttgagaatggatcttggatgtctattataggagaagtatgtgctgccaatgtacaagaaggcagcattgtaggattaacattcttgtctactgtatattatcttggaaggctcttgttaatatgttacacttaatattctccacagttacctttagagagaatttatgagaagttagtttctgatgcagaggtttttaggctgtgatttcatcaaaagtccttttagcattctacctcaaagggacacttagtatgcctaaaatttattcacttagttttccttttttatttgaaaaaatacatgacatgtaatctttttttcttgaattctttctcagattttaaagtactatattaaagaaaaaaattaatgtctaaagcctagcattcttgcagaaccctatactaacatgtaatggggagagggtggggcagatgagtagagaaacagattcaagcctcaagcttccaaagcatttttataaatggaaaatccttaaattatgaaacagcttgatatagtgtcctttttttaaaattcagaactttttttattgataatggagattgctgtttgagtttttaaacttaatctagaacagaggagtattaaaagtaatgctgtgctgcattatttaagactatcagcaaattatttgatagattgttcttacaacttgtattctgattacagaaccatcatgagtgtggaataaatactggattaaatcctttatcctgggtcttggcttttcccccatttgttaaatttttttagcatatttatattgtggaaattgatgaaacgtcagtagagtcacactttgtgtacagggatgtcttagtgcccagatgacaagtgaattttggagaaatgcatagactgggattgggcatgtggtaatcaataatctttattagaatacttgataatggcagttccctttgtcagtggttgttacatgtgtcatttgattactttgttccatgtcaaagacgtttattgggataccttttacttggacaatatgttagcattttttaaaatttggacttgaaattctttaagataattcacccaattctttttagaaaagaaaatagaggcccaaagtaatgatgtcagtgctagggctaaaactcagtattctgacagtgtagtgaacctggcacgcacattgaggtttgttttatctcactggttatactggccaactaatgcgcactcagaagccaccttgcaaaaatgttaaatggagcaaacgagtacacttgcaagagtcctccatatgtgggcttaacatatgtaccactccattttagaaaaatctcattaaatgaattcttctaaaaatga

SEQ ID NO: 290227 - DNA, 2434 bp, Homo sapiens
agtcttcctaccttttcctcctgtcttttctacttcagttttcctgacacaaacttctcctttcttattgagtcctgctatttgtgcctatgaaacatctctccctctcagctggattattatgaaagaggaaatgaacgagaaaaagagagagagcgatcaagagaaaggtccaaggaacagagaagtaggggagaggtagaagagaagaaacataaagaagacaaagatgataggcggcacagagatgacaaaagagattccaagaaagagaaaaaacacagtagaagcagaagcagagaaaggaaacacagaagtaggagtcgaagtagaaatgcagggaaacgaagtagaagtagaagcaaagagaaatcaagtaaacataaaaatgaaagtaaagaaaaatcaaataaacgaagtcgaagtggcagtcaaggaagaactgacagtgttgaaaaatcaaaaaaacgggaacatagtcccagcaaagaaaaatctagaaagcgtagtagaagcaaagaacgttcccacaaacgagatcacagtgatagtaaggaccagtcagacaaacatgatcgtcgaaggagccaaagtatagaacaagagagccaagaaaaacagcataaaaacaaagatgagactgtgtgaaaatattttgtaaaagtggatcacattgaatcctataaatgattaaatctgcttttttcccccacgttgagattgtgcagtagttcgcactcctcaagctctccctgtaggctgcattttcatttcctctttcgtgtagggaagtgcctttgtaattccatttattgcattggtgttttcacccaattgttaagtttgatacatgatgcacagattgttcttgcatttttattgtttgtttttgaaatgtacagtctgtacatatgtcctgaaaatgttttaattcctttggcatggttgccatgttggttaaatttgtataaggcaataaactgccactaatctatttttgttttgtaggtgtgggattatggtttgtgtactgaagttagcatggctgtgcttttcgtaatagaatgctaaagactttgagaatggatcttggatgtctattataggagaagtatgtgctgccaatgtacaagaaggcagcattgtaggattaacattcttgtctactgtatattatcttggaaggctcttgttaatatgttacacttaatattctccacagttacctttagagagaatttatgagaagttagtttctgatgcagaggtttttaggctgtgatttcatcaaaagtccttttagcattctacctcaaagggacacttagtatgcctaaaatttattcacttagttttccttttttatttgaaaaaatacatgacatgtaatctttttttcttgaattctttctcagattttaaagtactatattaaagaaaaaaattaatgtctaaagcctagcattcttgcagaaccctatactaacatgtaatggggagagggtggggcagatgagtagagaaacagattcaagcctcaagcttccaaagcatttttataaatggaaaatccttaaattatgaaacagcttgatatagtgtcctttttttaaaattcagaactttttttattgataatggagattgctgtttgagtttttaaacttaatctagaacagaggagtattaaaagtaatgctgtgctgcattatttaagactatcagcaaattatttgatagattgttcttacaacttgtattctgattacagaaccatcatgagtgtggaataaatactggattaaatcctttatcctgggtcttggcttttcccccatttgttaaatttttttagcatatttatattgtggaaattgatgaaacgtcagtagagtcacactttgtgtacagggatgtcttagtgcccagatgacaagtgaattttggagaaatgcatagactgggattgggcatgtggtaatcaataatctttattagaatacttgataatggcagttccctttgtcagtggttgttacatgtgtcatttgattactttgttccatgtcaaagacgtttattgggataccttttacttggacaatatgttagcattttttaaaatttggacttgaaattctttaagataattcacccaattctttttagaaaagaaaatagaggcccaaagtaatgatgtcagtgctagggctaaaactcagtattctgacagtgtagtgaacctggcacgcacattgaggtttgttttatctcactggttatactggccaactaatgcgcactcagaagccaccttgcaaaaatgttaaatggagcaaacgagtacacttgcaagagtcctccatatgtgggcttaacatatgtaccactccattttagaaaaatctcattaaatgaattcttctaaaaatga

SEQ ID NO: 290228 - DNA, 2403 bp, Homo sapiens
atacccaccatcgcatttccagggagatgagagtggaaagaccctgggcgctggtaggactacaccctgggataccagtgcagaagccgtgtcctggtgcagaaaggattttggtagggagcagaggaggcagaagtctgggctctggaccagttacctgaaggcattgcgaagtttctctcccactgggtatgtccggtccttcttctcaaactcatcgtcgaagagggctggagtgcagtggtgcagtcacggatcactgcagcttggaactcctgggctcaagccatcctccggcctcaacctcctgagtagctgggactacagggatggtgatgaaggaccccagaagcgctgcctgtacacccccaaccaggctccagtgggtgccacttgtcccggcctgaagtcacagcctccagatgctgcctccctctgccaattcctatacctgctggggtggacactgagggccagtcccagacttgggagcagggtgggagtgggatgggggtggtgcgtagggaggacctctatgtggccctgattgttggctcagtttcctctgcctgggggatgggttgagatgtcccctggttgtgacagaacagaggctgcaggttctcagcccctgcaatccccaccctgcatttggaacattctgtcctggctcctgagtctgaagaaggtgcaaaatgtgtggtttggaactcctattgaatctgagcgtggctctgcctcttgcagactcagaatcttttccattctagcttcagtgtgtctgagactcattgtttgctaaggattgattccatgaatgagtgacctgccctcagtggggcccatccttgatcgtaggctctgttgttgctgtcttgaaactcaataatgtctgaacaagagacccggatctccattttgcaccgggttctgtaaattatgtagccagtctcagttcacttttagttgtctgccctttagtatctttttcatatcgaaccacgtagatgtatttttaaaaatataaaatctaagtcgcacaaaagataaaaacaaagaaggacacatttattatttgttgtgcacctttagaaatggtccacaggtccactgcagtgcacaagctgctgcatgcacaccgcacgtgacaatccagtctgcctgactcccaggacagcctgtgtgatatgcaaaatgccattcccatgagggcgcatcatgtttcccaggagctctgaaggacacagatagagcttgtgctctaggctgcccccctgttcccgtgctggctccatgctggtgtccagaatgagccagttcacactccagtgccacgtggggggagaagtggcccccaaactcccctgctgacctccccccggcccctaggtgtaccttccaagtcagatgacagtcataggctaacatccccagctttgcctggaactcaggaaaggatacttacgggtagacagaaagattctgcagtgggcatggacttggccattgaagaccctgagaggacatcttgtccaccctctccaggctaggccctgtctgtgctgcctggagccagaagaaaaagattccagccttggaatctgcagggagggagactccttgcagtgagctttcttgcatttcattctagtatttgccacagatgctgatttcttgcctgagtcatatatattgaagtttttgctcatttcttactaggcttaagaaattggaattctctgccttacaaatcccaaagggctaaacatgcctccaagcccatgaacaagctttgagcatctgaaggacaaaaccccagctcctaaaacgttcatgagcatccactttctgctcagcctggaagagaaggagcactgctgccctctggtggtcaggcagcagagcatctaggagccacccaagggagctgggtcccctttgctttgtctttgggacagcagctttgagtattaggtcaatggatgtcctttcactgttcctggaacatggcaagcttgtttttgcctcagggctttgggtcttgatgctccctctccctggaatgttctttctccagctctcaggtgacagctgctttcacattctctagccctcagaccagatgccacctcctcagggaagccctcctggaccacttcatctaaaatagcaactcatcccaccccctgtcactctatcccattaccctgtttccctttgtttatagcacttacctgctatttggaaatatctgtctagagtctgcgtctctccctcaccagatgtcggctccaggagggcagagtccctgtgttttgtttgtcactggacttcaatgcatcgtacatagtagatacgcaaaaataaacttgtcaaagaagtaaataaatgcatattgacaac

SEQ ID NO: 290229 - DNA, 1182 bp, Homo sapiens
gtggacatctgagcttgaaatataaagccaaatacaactgaagttcaaaggtggaattgaacccagataacccacctcttctctgactaataaaagagagctagtaccgcccaggagggcagagcagtgattttctgtaggcatgaaacgtgaactcatttactatccctgagataaaacagcccagccctgctcaacccacagaaaacagttgagagccctgcagaaacctggctgttgagcggcactgcaaatgaggtgagttttcatgtgtgtgtgctgaagccctcagaaatctcccagatccttattcctacaggagctgccactcctggagtaaccttgtataggttgttttcagtgtccttgtgccactcccccactccttaaagtggccacagcatgagtcccaatgaggaatcgggtgacctagtttcttgaccactaattctcccagtgatgtgtcccttcttctggccccagcctggtaggagaccatggcagagaaagctgatcccatctgcttcggggggacaatgctgccacaggtcccctccagcctctgaagacattgggtgcttttgtaaacagatgattagggtatgctctgatggggctttttaagcagcaaacccctttctttcatgcagcttcccatatgaagtaagcatgtcccacaagtggggacctggccatgggactctggtttgccattattaggacaaataggatcttagcgtgaccagagcagacactgttcaagcacgtcaaaacattaaaaaaaaaaattatccccacaaatgacttattaatgacagagaagaaaatgtacctgcaatggggcgatctggcagacacttcccaatcaagtcatcaaattcagcagcctccaaagtggggccaccagacatgatgtcctcggctcctgaagggaggcactggaagacacagcatcacttgagccatgtgctcccccaacatgcttcacctgaatctgctcctcaagagacaaccagacaagaaatccagaaagagaaactccacaacacaacagtcttggactctacaaaacattcattgtcactaattgactttctaaacgataagatgaaagagaaataacagccgggtgcagtggctcacacctgtaatcccagcactttgggaggccgaggcgggtgg

SEQ ID NO: 290230 - DNA, 790 bp, Homo sapiens
gtggacatctgagcttgaaatataaagccaaatacaactgaagttcaaaggtggaattgaacccagataacccacctcttctctgactaataaaagagagctagtaccgcccaggagggcagagcagtgattttctgtaggcatgaaacgtgaactcatttactatccctgagataaaacagcccagccctgctcaacccacagaaaacagttgagagccctgcagaaacctggctgttgagcggcactgcaaatgagcttcccatatgaagtaagcatgtcccacaagtggggacctggccatgggactctggtttgccattattaggacaaataggatcttagcgtgaccagagcagacactgttcaagcacgtcaaaacattaaaaaaaaaaattatccccacaaatgacttattaatgacagagaagaaaatgtacctgcaatggggcgatctggcagacacttcccaatcaagtcatcaaattcagcagcctccaaagtggggccaccagacatgatgtcctcggctcctgaagggaggcactggaagacacagcatcacttgagccatgtgctcccccaacatgcttcacctgaatctgctcctcaagagacaaccagacaagaaatccagaaagagaaactccacaacacaacagtcttggactctacaaaacattcattgtcactaattgactttctaaacgataagatgaaagagaaataacagccgggtgcagtggctcacacctgtaatcccagcactttgggaggccgaggcgggtgg

SEQ ID NO: 290231 - DNA, 639 bp, Homo sapiens
ggctggcacagggctcaggtacattctagatggctgtcaggtggcgggcgctttagtcacattgaatttgtcttggtggttgatttttgtccacgcccccatcagtttatcgtgttttttacctttgatcccagggcgagaaccccggctctcccctgccccacctcacccacccagagaagcacagaccccgccaggggcaggggcccaccgcacacccttgtcccgggcctgtctgggactggccttcccggctcagccagtgaggctcagaagggacacaaagagggatggaagaaaagaacaaagagaaactgttcctcccacccccttccctgatgccaggggcaccagactgattctgaggcacaaataaaagaggcttcataccggaggcttttgctacctaactttacttggggggaacgcctacggtgtgggttggggtccttctgaacctcagagtggagagagctctagggtaagaggctgcctgatggaccctgagcccaggagtgcatcgccaggtctcccaggagcctgggggtagcatttgcagaggctgggggtctcgttcccctcactcccacccatgcaggaggcacagactgaacgcttagtaaaatatttcattcagta

SEQ ID NO: 290232 - DNA, 3014 bp, Homo sapiens
cggcagatgcccggccccggcgggcagcgtggcctgcggccctggcctccgctgcagcgctcgcctggcccggaggcaatgtggacatcgagcagctggatccccgcggccggactcccctgcacctggccaccacgctggggcaccttgagtgtgcccgtgtgctcctggcgcacggcgcagacgtgggcagggagaatcgcagcggctggacaggtgggcagccctgctcaccccagccccacagccggggcctccccagcatcatagacctatggttggctgaagggtcctgccctgtgaccttgcctcgccctcccccagtgctccaggaggctgcccaggacttctacgtggagatgaaatgggagttcactagctgggtgcccctggtgtccaagatctgccctagtgacacctacaaagtgtggaagagcggccagaacctgagggtagacaccacactcctgggctttgaccacatgacctggcagcgagggaaccgcagctttgtcttcaggggccaagacacaagcgccgtggtcatggagattgaccacgaccgccgggtggtgtacacagagactctggcactggctgggcaggaccgggagctgctgctggctgctgctcagcccactgaggaacaggtgctgagccggcttaccgcgcccgtcgtcaccactcagcttgacaccaagaatatctcctttgagaggaacaagactggcatcctgggctggcgcagtgaaaagacggagatggtgaatgggtatgaagctaaggtgtatggggcatctaacgtggagctcatcacccgcacacggacagaacatctttcagaacagcacaagggcaaggtcaaaggctgtaagacacctttgcagtccttcctgggaatcgctgagcagcacgggggcccccaaaatgggaccctgatcactcagactctgagccaagccaaccccactgccatcactgcagaagaatacttcaaccccaactttgagctgggcaaccgtgatatgggccgccccatggaactgaccaccaagacacagaagttcaaggccaagctgtggctgtgtgaggagcatcccctgtccctgtgtgagcaggtggcccccatcattgacctcatggccgtcagcaatgcgctttttgccaagctccgggacttcatcaccctgcgtctgcctcctggcttcccagttaagattgaaatcccgatcttccacatcctcaacgcccgcatcaccttcgggaacctcaacggctgcgacgaaccggtgccatcggtgcgaggcagccccagcagcgagacgccttccccaggcagcgactcctccagcgtcagcagctccagctccacgacctcctgccgcggctgcgagatctccccagcgttgttcgaggccccgcgcggctacagcatgatgggcggccagcgggaggcggcgacccgggacgacgacgacgacctgctgcaattcgccatccagcagagcctgcttgaggcgggcagtgagtatgaccaggtcaccatctgggaggcgctaaccaacagcaagccaggcacccaccccatgtcctacgagggtcgccgacaggacaggagcgccccgcccacgccgcagcgccagcctgcgcccccggcgtcagtgcccagccctcggcccagctcagggccaggttccggcggccacgtgttccggagctacgacgagcagctgcggctggcgatggaactgtcggcgcaggagcaggaggagaggcggcggcgcgcgcgccaggaggaggaggagctggagcgcatcctgaggctctcactgaccgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcaggcacggttcggggagggattcggcatggccgcggggtaccttcccaggccagggccctggaggcaactggcacggcctggtccccctgctttgctgtattctgattccccaacccgctcccctgggctcagatctgtcctgtcctagggcggagccaggcggtcctgagggggagatgaatccttagaggagcgctgtccctatcccttgctccttctggccggtccgcatttctgttcactaaccccactccaggacactgcccctgaagcctttgcatctctgctcttcactcctggggggcagctgagctccccgcgtgctgtgtcactgctttgttccagacacaaaccagcacgtctagggcccagcccctcccccaccccggcatttcagcgtcaagtgcacttagcggggtacccggctcccccagcccccacacccgtcctgggtctcagggtggttccagcttctccttgggcagccagaagttggagtcccatcccccaaggcacattttttttttttttgtgatcagggagtgtgtccaacgtagccccctggcctgtgcaagccctgactccctcatggtgcctcggagagtggggagcatattgggctggggtaagcactagacccaagtagactggacacaaagggctcgcccagggccctggcgccacccccaccccttcccaccagctgctgctagcctctgtggttgtacatcccacttgcccccacacggagactgactctaaaacccttcatccaatggtgctaacccccggctctcccctgccccacctcacccacccagagaagcacagaccccgccaggggcaggggcccaccgcacacccttgtcccgggcctgtctgggactggccttcccggctcagccagtgaggctcagaagggacacaaagagggatggaagaaaagaacaaagagaaactgttcctcccacccccttccctgatgccaggggcaccagactgattctgaggcacaaataaaagaggcttcatac

SEQ ID NO: 290233 - DNA, 3263 bp, Homo sapiens
cggcagatgcccggccccggcgggcagcgtggcctgcggccctggcctccgctgcagcgctcgcctggcccggaggcaatgtggacatcgagcagctggatccccgcggccggactcccctgcacctggccaccacgctggggcaccttgagtgtgcccgtgtgctcctggcgcacggcgcagacgtgggcagggagaatcgcagcggctggacaggtgggcagccctgctcaccccagccccacagccggggcctccccagcatcatagacctatggttggctgaagggtcctgccctgtgaccttgcctcgccctcccccagtgctccaggaggctgcccaggacttctacgtggagatgaaatgggagttcactagctgggtgcccctggtgtccaagatctgccctagtgacacctacaaagtgtggaagagcggccagaacctgagggtagacaccacactcctgggctttgaccacatgacctggcagcgagggaaccgcagctttgtcttcaggggccaagacacaagcgccgtggtcatggagattgaccacgaccgccgggtggtgtacacagagactctggcactggctgggcaggaccgggagctgctgctggctgctgctcagcccactgaggaacaggtgctgagccggcttaccgcgcccgtcgtcaccactcagcttgacaccaagaatatctcctttgagaggaacaagactggcatcctgggctggcgcagtgaaaagacggagatggtgaatgggtatgaagctaaggtgtatggggcatctaacgtggagctcatcacccgcacacggacagaacatctttcagaacagcacaagggcaaggtcaaaggctgtaagacacctttgcagtccttcctgggaatcgctgagcagcacgggggcccccaaaatgggaccctgatcactcagactctgagccaagccaaccccactgccatcactgcagaagaatacttcaaccccaactttgagctgggcaaccgtgatatgggccgccccatggaactgaccaccaagacacagaagttcaaggccaagctgtggctgtgtgaggagcatcccctgtccctgtgtgagcaggtggcccccatcattgacctcatggccgtcagcaatgcgctttttgccaagctccgggacttcatcaccctgcgtctgcctcctggcttcccagttaagattgaaatcccgatcttccacatcctcaacgcccgcatcaccttcgggaacctcaacggctgcgacgaaccggtgccatcggtgcgaggcagccccagcagcgagacgccttccccaggcagcgactcctccagcgtcagcagctccagctccacgacctcctgccgcggctgcgagatctccccagcgttgttcgaggccccgcgcggctacagcatgatgggcggccagcgggaggcggcgacccgggacgacgacgacgacctgctgcaattcgccatccagcagagcctgcttgaggcgggcagtgagtatgaccaggtcaccatctgggaggcgctaaccaacagcaagccaggcacccaccccatgtcctacgagggtcgccgacaggacaggagcgccccgcccacgccgcagcgccagcctgcgcccccggcgtcagtgcccagccctcggcccagctcagggccaggttccggcggccacgtgttccggagctacgacgagcagctgcggctggcgatggaactgtcggcgcaggagcaggaggagaggcggcggcgcgcgcgccaggaggaggaggagctggagcgcatcctgaggctctcactgaccgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcaggcacggttcggggagggattcggcatggccgcggggtaccttcccaggccagggccctggaggcaactggcacggcctggtccccctgctttgctgtattctgattccccaacccgctcccctgggctcagatctgtcctgtcctagggcggagccaggcggtcctgagggggagatgaatccttagaggagcgctgtccctatcccttgctccttctggccggtccgcatttctgttcactaaccccactccaggacactgcccctgaagcctttgcatctctgctcttcactcctggggggcagctgagctccccgcgtgctgtgtcactgctttgttccagacacaaaccagcacgtctagggcccagcccctcccccaccccggcatttcagcgtcaagtgcacttagcggggtacccggctcccccagcccccacacccgtcctgggtctcagggtggttccagcttctccttgggcagccagaagttggagtcccatcccccaaggcacattttttttttttttgtgatcagggagtgtgtccaacgtagccccctggcctgtgcaagccctgactccctcatggtgcctcggagagtggggagcatattgggctggggtaagcactagacccaagtagactggacacaaagggctcgcccagggccctggcgccacccccaccccttcccaccagctgctgctagcctctgtggttgtacatcccacttgcccccacacggagactgactctaaaacccttcatccaatggtgctaacccccggctctcccctgccccacctcacccacccagagaagcacagaccccgccaggggcaggggcccaccgcacacccttgtcccgggcctgtctgggactggccttcccggctcagccagtgaggctcagaagggacacaaagagggatggaagaaaagaacaaagagaaactgttcctcccacccccttccctgatgccaggggcaccagactgattctgaggcacaaataaaagaggcttcataccggaggcttttgctacctaactttacttggggggaacgcctacggtgtgggttggggtccttctgaacctcagagtggagagagctctagggtaagaggctgcctgatggaccctgagcccaggagtgcatcgccaggtctcccaggagcctgggggtagcatttgcagaggctgggggtctcgttcccctcactcccacccatgcaggaggcacagactgaacgcttagtaaaatatttcattcagta

SEQ ID NO: 290234 - DNA, 2831 bp, Homo sapiens
tgcccgtcccgacctcaggttgctcttctgtgtgagtatggtctacactggccagggagggggttttggaggagaggctgctctctcttcagttccctcccctgttcctggccacacggatcccaaaccccatgccctgagctggtccaggccgtgtaggccagaccagtcaaagccacctccaacctccgcttccaccagtgcccctggtgtccaagatctgccctagtgacacctacaaagtgtggaagagcggccagaacctgagggtagacaccacactcctgggctttgaccacatgacctggcagcgagggaaccgcagctttgtcttcaggggccaagacacaagcgccgtggtcatggagattgaccacgaccgccgggtggtgtacacagagactctggcactggctgggcaggaccgggagctgctgctggctgctgctcagcccactgaggaacaggtgctgagccggcttaccgcgcccgtcgtcaccactcagcttgacaccaagaatatctcctttgagaggaacaagactggcatcctgggctggcgcagtgaaaagacggagatggtgaatgggtatgaagctaaggtgtatggggcatctaacgtggagctcatcacccgcacacggacagaacatctttcagaacagcacaagggcaaggtcaaaggctgtaagacacctttgcagtccttcctgggaatcgctgagcagcacgggggcccccaaaatgggaccctgatcactcagactctgagccaagccaaccccactgccatcactgcagaagaatacttcaaccccaactttgagctgggcaaccgtgatatgggccgccccatggaactgaccaccaagacacagaagttcaaggccaagctgtggctgtgtgaggagcatcccctgtccctgtgtgagcaggtggcccccatcattgacctcatggccgtcagcaatgcgctttttgccaagctccgggacttcatcaccctgcgtctgcctcctggcttcccagttaagattgaaatcccgatcttccacatcctcaacgcccgcatcaccttcgggaacctcaacggctgcgacgaaccggtgccatcggtgcgaggcagccccagcagcgagacgccttccccaggcagcgactcctccagcgtcagcagctccagctccacgacctcctgccgcggctgcgagatctccccagcgttgttcgaggccccgcgcggctacagcatgatgggcggccagcgggaggcggcgacccgggacgacgacgacgacctgctgcaattcgccatccagcagagcctgcttgaggcgggcagtgagtatgaccaggtcaccatctgggaggcgctaaccaacagcaagccaggcacccaccccatgtcctacgagggtcgccgacaggacaggagcgccccgcccacgccgcagcgccagcctgcgcccccggcgtcagtgcccagccctcggcccagctcagggccaggttccggcggccacgtgttccggagctacgacgagcagctgcggctggcgatggaactgtcggcgcaggagcaggaggagaggcggcggcgcgcgcgccaggaggaggaggagctggagcgcatcctgaggctctcactgaccgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcaggcacggttcggggagggattcggcatggccgcggggtaccttcccaggccagggccctggaggcaactggcacggcctggtccccctgctttgctgtattctgattccccaacccgctcccctgggctcagatctgtcctgtcctagggcggagccaggcggtcctgagggggagatgaatccttagaggagcgctgtccctatcccttgctccttctggccggtccgcatttctgttcactaaccccactccaggacactgcccctgaagcctttgcatctctgctcttcactcctggggggcagctgagctccccgcgtgctgtgtcactgctttgttccagacacaaaccagcacgtctagggcccagcccctcccccaccccggcatttcagcgtcaagtgcacttagcggggtacccggctcccccagcccccacacccgtcctgggtctcagggtggttccagcttctccttgggcagccagaagttggagtcccatcccccaaggcacattttttttttttttgtgatcagggagtgtgtccaacgtagccccctggcctgtgcaagccctgactccctcatggtgcctcggagagtggggagcatattgggctggggtaagcactagacccaagtagactggacacaaagggctcgcccagggccctggcgccacccccaccccttcccaccagctgctgctagcctctgtggttgtacatcccacttgcccccacacggagactgactctaaaacccttcatccaatggtgctaacccccggctctcccctgccccacctcacccacccagagaagcacagaccccgccaggggcaggggcccaccgcacacccttgtcccgggcctgtctgggactggccttcccggctcagccagtgaggctcagaagggacacaaagagggatggaagaaaagaacaaagagaaactgttcctcccacccccttccctgatgccaggggcaccagactgattctgaggcacaaataaaagaggcttcatac

SEQ ID NO: 290235 - DNA, 1602 bp, Homo sapiens
gactctccccaggcattgacggggagaacttggtagggtctgggctccgccacgaccaggtgggggccaggacgccgcgggactgaccgcctccactagagggtggtggccgcgggccgccctggagcctccacgccgtgtcccggccccggccggtgggtgggtgcgcccgggagcccgcgacattccttccccacccccaggagcgccccgcccacgccgcagcgccagcctgcgcccccggcgtcagtgcccagccctcggcccagctcagggccaggttccggcggccacgtgttccggagctacgacgagcagctgcggctggcgatggaactgtcggcgcaggagcaggaggagaggcggcggcgcgcgcgccaggaggaggaggagctggagcgcatcctgaggctctcactgaccgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcaggcacggttcggggagggattcggcatggccgcggggtaccttcccaggccagggccctggaggcaactggcacggcctggtccccctgctttgctgtattctgattccccaacccgctcccctgggctcagatctgtcctgtcctagggcggagccaggcggtcctgagggggagatgaatccttagaggagcgctgtccctatcccttgctccttctggccggtccgcatttctgttcactaaccccactccaggacactgcccctgaagcctttgcatctctgctcttcactcctggggggcagctgagctccccgcgtgctgtgtcactgctttgttccagacacaaaccagcacgtctagggcccagcccctcccccaccccggcatttcagcgtcaagtgcacttagcggggtacccggctcccccagcccccacacccgtcctgggtctcagggtggttccagcttctccttgggcagccagaagttggagtcccatcccccaaggcacattttttttttttttgtgatcagggagtgtgtccaacgtagccccctggcctgtgcaagccctgactccctcatggtgcctcggagagtggggagcatattgggctggggtaagcactagacccaagtagactggacacaaagggctcgcccagggccctggcgccacccccaccccttcccaccagctgctgctagcctctgtggttgtacatcccacttgcccccacacggagactgactctaaaacccttcatccaatggtgctaacccccggctctcccctgccccacctcacccacccagagaagcacagaccccgccaggggcaggggcccaccgcacacccttgtcccgggcctgtctgggactggccttcccggctcagccagtgaggctcagaagggacacaaagagggatggaagaaaagaacaaagagaaactgttcctcccacccccttccctgatgccaggggcaccagactgattctgaggcacaaataaaagaggcttcatac

SEQ ID NO: 290236 - DNA, 813 bp, Homo sapiens
ccaggaaggggacggcgtcctgaaagggacatttgaaaaacggaggcaacgcgtctattaattaggtggcggcgcctggggtcgcagcactccagaggctgagagtctcgcccttttgcctagtggaggagctcggctcactgcaagctccgcgccacaacccccctgccgccccaggttcaagagattctcctgcctcagtctcccgagtagactgggattacagaatgctggggtggaagagttcccagttttaaaggagaagtacaagaagacctgtaattgttagcaagatatacagaacacagtgcacacagcagcgcacttctcaagtcaggtcctccaagatgctcggcatgggctgaggcgcctcctcctcctccttactgcccagttcatcgcctgtgaggggtggccagaggggtcctcggacaactcaacaagggagatggtcagaacgatcaagcgacctctccaaggcggggactgaagcgtcaggtctcacctgctccaacatctcctgcatcctctgccacacgcggcatgctctccatggagatactcagcgtactcgtctctccatttgtagatactgcagccactccatcacctgcgagaattgacacagaagttaggaagggctgtcactggtcctcacatactcctggccacctggggtcatcttccttccacgtccctccctctgcaaagcctcacgtgccccaggtatgcttccagctgtgcccgctcctccatggcctgctgtaactgctggttagcatccagggctttgcagcatctagacaactggat

SEQ ID NO: 290237 - DNA, 736 bp, Homo sapiens
  misc_feature (1)..(1): n is a, c, g, or t
naatcttcggctaggtacgaggcctgggtgtcgctgagtcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgccagggtgcagctatcttctcccaagacagctcttctcagcactggggagtgactccagagcagtgtgcccgttggttgggggggcctcttggggctggccatggggattccccctttca

SEQ ID NO: 290238 - DNA, 7474 bp, Homo sapiens
  misc_feature (108)..(108): n is a, c, g, or t
  misc_feature (118)..(118): n is a, c, g, or t
  misc_feature (126)..(126): n is a, c, g, or t
  misc_feature (129)..(129): n is a, c, g, or t
  misc_feature (132)..(135): n is a, c, g, or t
tataagataaaacaaatcatgcatcattttattccagattgctcttgcccaaagaggtgatctctcagatgtggaggaagaggaagaagaagagatggatgtagatgnagccacaggngcagttangangcnnnntggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaactttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaatcttgtgtatttttttttgttcctaatgattttatagacaaagactcttggcaaccccaggagaaaaaaaataaagctgtcagtggagtactagggatgagaatgaaactggaggtctgtttctggtattatggcttcccgggactctacagtcctgtatggtgaaatacatttttccattgggatcgtcaatgccatgactgttctgccacctcaaactccagagtttctggtgatgtgcaagagttagcaatatacattcagtaaagcgtgtaatcgagtaagtcgtagtaacttgggcgtaaagctctaccaccctgctcactaacaccctgatctccgtccggtatgaaaacacctattccgggtagtctggctccacgttaagcaaacaccactttccgtgttcaccgacagctagagccagaggtctcccggttgctgcttctgaggctgggtctgcagcagctgaggctcccgcctgtcttgccgaatggcctaagtctctgtcttgagactttcgagagttctaatcgtcaaatttcccattttattttgagattttccctgcggcccactatttcggacaacataggagagcctcaaaaacagtttctagcttccaactcggctcaaagttcagacagcagctgggcttccgagagccgccggtgttccaagaaaagctgcccgggactgggaggcgccctctggacgccggaacctttggtttcctgccgtggagcggaacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggtgtggcccctggtcccccgcagccggccgaccgcaaccgtgcgcctcaagctttccttccggggagaaacctaagctgcagccacccgggccgcgggacaaagtgcccgccgcgggcagggcaggggccggggaggagggggtagggaatggactgtgccgcggagcggccaggcagccctcttggcggaggatccagggaaagtgcggccccaccggccagctggcccccaggcggaaacggggcggcctccagcatgtgcccaccggcccgtcccacgcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaaggctggagtgcaatggcacgatctcggctcactgcgaccgccgcctcccaggttcaagcaattctcctgcctcagcctccctactagctgagattacagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctgggctgccggaacctttggtacttcggacagtccccccgatctggccggtgttggcttgggggttttcaccagaatgggcggattggggagtcttcccgccgacttttttgggaggccggtgtccggtttggccaccccggcaacaaagcacagcacgagagcggttagaacggcaaacgaaagggggccaggcacttatgggggggcccaagcagctcatacgacgctatttcttctttgttgctactcccttgttgcttctctaataacaacaagactaaatacaagacaacgaacagtaaagcacacaaaaaaaaagacaccagaagcaactaactaagacaacaaaacgacaaacaaacacaggcaaggcgacgagaccagacccacaaaaacaggacagacaggcagcgaggacagcagcgcaagaactgaaggcgacaggcagaagggcagcgcgagctaaccgaggaagcgcgcgaggccaccggcagagcgaggggagagacaggaggagatgcgcgcacagcagaaaagaacacgcgcgagaagagcggcctgacagacagaagcagaagggagagagaagacgaaaggacagcagggtagacagagagacgaagcagaacaacagggcaccgcagacaacggaaggggagcaagagacgagtaacgagggaggagacgcagagggagggcgaggcagacagacccaggcgggacgaagcgcgcgaagggaggcgcgagaggagccagaggaaagcagagggagcgaacgggcgaagcaagagagcaaggcaggacaggcgcgggacagggcgcggcagggcagcaagaagagaagagcgacagggaggcagcgacagagcacggaggcaacagcagcgaagcagagcaggaggagtgaaacgcaaggcaaagagacgaagagggaggccgagcaacgtaggcaggagagagcggcgggacactggagggaggagagagagacgggggcggagaaggagcagagagggagaggggagcgagaagagaggacagacgaagcgggcccaggaagaacgagaggcaacagacagaagggagagcagaagagccgagacacgagggcagaggaaaggagcacgcaagcgcgggagagaggcgagagagccgagaacaggagaaggcaggcacgagagaagcaagaggaggaagag

SEQ ID NO: 290239 - DNA, 7043 bp, Homo sapiens
  misc_feature (108)..(108): n is a, c, g, or t
  misc_feature (118)..(118): n is a, c, g, or t
  misc_feature (126)..(126): n is a, c, g, or t
  misc_feature (129)..(129): n is a, c, g, or t
  misc_feature (132)..(135): n is a, c, g, or t
tataagataaaacaaatcatgcatcattttattccagattgctcttgcccaaagaggtgatctctcagatgtggaggaagaggaagaagaagagatggatgtagatgnagccacaggngcagttangangcnnnntggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaactttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaatcttgtgtatttttttttgttcctaatgattttatagacaaagactcttggcaaccccaggagaaaaaaaataaagctgtcagtggagtactagggatgagaatgaaactggaggtctgtttctggtattatggcttcccgggactctacagtcctgtatggtgaaatacatttttccattgggatcgtcaatgccatgactgttctgccacctcaaactccagagtttctggtgatgtgcaagagttagcaatatacattcagtaaagcgtgtaatcgagtaagtcgtagtaacttgggcgtaaagctctaccaccctgctcactaacaccctgatctccgtccggtatgaaaacacctattccgggtagtctggctccacgttaagcaaacaccactttccgtgttcaccgacagctagagccagaggtctcccggttgctgcttctgaggctgggtctgcagcagctgaggctcccgcctgtcttgccgaatggcctaagtctctgtcttgagactttcgagagttctaatcgtcaaatttcccattttattttgagattttccctgcggcccactatttcggacaacataggagagcctcaaaaacagtttctagcttccaactcggctcaaagttcagacagcagctgggcttccgagagccgccggtgttccaagaaaagctgcccgggactgggaggcgccctctggacgccggaacctttggtttcctgccgtggagcggaacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggtgtggcccctggtcccccgcagccggccgaccgcaaccgtgcgcctcaagctttccttccggggagaaacctaagctgcagccacccgggccgcgggacaaagtgcccgccgcgggcagggcaggggccggggaggagggggtagggaatggactgtgccgcggagcggccaggcagccctcttggcggaggatccagggaaagtgcggccccaccggccagctggcccccaggcggaaacggggcggcctccagcatgtgcccaccggcccgtcccacgcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaaggctggagtgcaatggcacgatctcggctcactgcgaccgccgcctcccaggttcaagcaattctcctgcctcagcctccctactagctgagattacagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagatcaagaaggggaaccgggaatgtgagcggatcctgcacgacgtggagctgctcagtagcctggccctggccgcagtgcccagttcctatacccagcagcccagctgcagcacctctggaggctccttcttctgaaccagttccatgatgtggtgactggaagctgcatccagatggtggcaagaggaagcccatgttgccattattgaagacatccgttccacattggcaatacaactgtcaggcgctggaggccgcagcctgtgttgcctggggaggccagtcctgaagggcctcctcatcggtcaaaacaactggcccttgggagcggatcgaaattgattgggcgcttggcccaaacgggggggggggcccacaaagcttaagaaagcctgtgtggggccggcaggggcc

SEQ ID NO: 290240 - DNA, 7190 bp, Homo sapiens
  misc_feature (108)..(108): n is a, c, g, or t
  misc_feature (118)..(118): n is a, c, g, or t
  misc_feature (126)..(126): n is a, c, g, or t
  misc_feature (129)..(129): n is a, c, g, or t
  misc_feature (132)..(135): n is a, c, g, or t
tataagataaaacaaatcatgcatcattttattccagattgctcttgcccaaagaggtgatctctcagatgtggaggaagaggaagaagaagagatggatgtagatgnagccacaggngcagttangangcnnnntggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaactttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaatcttgtgtatttttttttgttcctaatgattttatagacaaagactcttggcaaccccaggagaaaaaaaataaagctgtcagtggagtactagggatgagaatgaaactggaggtctgtttctggtattatggcttcccgggactctacagtcctgtatggtgaaatacatttttccattgggatcgtcaatgccatgactgttctgccacctcaaactccagagtttctggtgatgtgcaagagttagcaatatacattcagtaaagcgtgtaatcgagtaagtcgtagtaacttgggcgtaaagctctaccaccctgctcactaacaccctgatctccgtccggtatgaaaacacctattccgggtagtctggctccacgttaagcaaacaccactttccgtgttcaccgacagctagagccagaggtctcccggttgctgcttctgaggctgggtctgcagcagctgaggctcccgcctgtcttgccgaatggcctaagtctctgtcttgagactttcgagagttctaatcgtcaaatttcccattttattttgagattttccctgcggcccactatttcggacaacataggagagcctcaaaaacagtttctagcttccaactcggctcaaagttcagacagcagctgggcttccgagagccgccggtgttccaagaaaagctgcccgggactgggaggcgccctctggacgccggaacctttggtttcctgccgtggagcggaacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaaggctggagtgcaatggcacgatctcggctcactgcgaccgccgcctcccaggttcaagcaattctcctgcctcagcctccctactagctgagattacagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctgggctgccggaacctttggtacttcggacagtccccccgatctggccggtgttggcttgggggttttcaccagaatgggcggattggggagtcttcccgccgacttttttgggaggccggtgtccggtttggccaccccggcaacaaagcacagcacgagagcggttagaacggcaaacgaaagggggccaggcacttatgggggggcccaagcagctcatacgacgctatttcttctttgttgctactcccttgttgcttctctaataacaacaagactaaatacaagacaacgaacagtaaagcacacaaaaaaaaagacaccagaagcaactaactaagacaacaaaacgacaaacaaacacaggcaaggcgacgagaccagacccacaaaaacaggacagacaggcagcgaggacagcagcgcaagaactgaaggcgacaggcagaagggcagcgcgagctaaccgaggaagcgcgcgaggccaccggcagagcgaggggagagacaggaggagatgcgcgcacagcagaaaagaacacgcgcgagaagagcggcctgacagacagaagcagaagggagagagaagacgaaaggacagcagggtagacagagagacgaagcagaacaacagggcaccgcagacaacggaaggggagcaagagacgagtaacgagggaggagacgcagagggagggcgaggcagacagacccaggcgggacgaagcgcgcgaagggaggcgcgagaggagccagaggaaagcagagggagcgaacgggcgaagcaagagagcaaggcaggacaggcgcgggacagggcgcggcagggcagcaagaagagaagagcgacagggaggcagcgacagagcacggaggcaacagcagcgaagcagagcaggaggagtgaaacgcaaggcaaagagacgaagagggaggccgagcaacgtaggcaggagagagcggcgggacactggagggaggagagagagacgggggcggagaaggagcagagagggagaggggagcgagaagagaggacagacgaagcgggcccaggaagaacgagaggcaacagacagaagggagagcagaagagccgagacacgagggcagaggaaaggagcacgcaagcgcgggagagaggcgagagagccgagaacaggagaaggcaggcacgagagaagcaagaggaggaagag

SEQ ID NO: 290241 - DNA, 5274 bp, Homo sapiens
  misc_feature (108)..(108): n is a, c, g, or t
  misc_feature (118)..(118): n is a, c, g, or t
  misc_feature (126)..(126): n is a, c, g, or t
  misc_feature (129)..(129): n is a, c, g, or t
  misc_feature (132)..(135): n is a, c, g, or t
tataagataaaacaaatcatgcatcattttattccagattgctcttgcccaaagaggtgatctctcagatgtggaggaagaggaagaagaagagatggatgtagatgnagccacaggngcagttangangcnnnntggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaactttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaatcttgtgtatttttttttgttcctaatgattttatagacaaagactcttggcaaccccaggagaaaaaaaataaagctgtcagtggagtactagggatgagaatgaaactggaggtctgtttctggtattatggcttcccgggactctacagtcctgtatggtgaaatacatttttccattgggatcgtcaatgccatgactgttctgccacctcaaactccagagtttctggtgatgtgcaagagttagcaatatacattcagtaaagcgtgtaatcgagtaagtcgtagtaacttgggcgtaaagctctaccaccctgctcactaacaccctgatctccgtccggtatgaaaacacctattccgggtagtctggctccacgttaagcaaacaccactttccgtgttcaccgacagctagagccagaggtctcccggttgctgcttctgaggctgggtctgcagcagctgaggctcccgcctgtcttgccgaatggcctaagtctctgtcttgagactttcgagagttctaatcgtcaaatttcccattttattttgagattttccctgcggcccactatttcggacaacataggagagcctcaaaaacagtttctagcttccaactcggctcaaagttcagacagcagctgggcttccgagagccgccggtgttccaagaaaagctgcccgggactgggaggcgccctctggacgccggaacctttggtttcctgccgtggagcggaacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggtgtggcccctggtcccccgcagccggccgaccgcaaccgtgcgcctcaagctttccttccggggagaaacctaagctgcagccacccgggccgcgggacaaagtgcccgccgcgggcagggcaggggccggggaggagggggtagggaatggactgtgccgcggagcggccaggcagcccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaaaaaaaaaa

SEQ ID NO: 290242 - DNA, 3693 bp, Homo sapiens
  misc_feature (108)..(108): n is a, c, g, or t
  misc_feature (118)..(118): n is a, c, g, or t
  misc_feature (126)..(126): n is a, c, g, or t
  misc_feature (129)..(129): n is a, c, g, or t
  misc_feature (132)..(135): n is a, c, g, or t
tataagataaaacaaatcatgcatcattttattccagattgctcttgcccaaagaggtgatctctcagatgtggaggaagaggaagaagaagagatggatgtagatgnagccacaggngcagttangangcnnnntggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaactttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtctaactctggacctactgtaaccatccgatgtttcgtacaggacc

SEQ ID NO: 290243 - DNA, 7134 bp, Homo sapiens
  misc_feature (108)..(108): n is a, c, g, or t
  misc_feature (118)..(118): n is a, c, g, or t
  misc_feature (126)..(126): n is a, c, g, or t
  misc_feature (129)..(129): n is a, c, g, or t
  misc_feature (132)..(135): n is a, c, g, or t
tataagataaaacaaatcatgcatcattttattccagattgctcttgcccaaagaggtgatctctcagatgtggaggaagaggaagaagaagagatggatgtagatgnagccacaggngcagttangangcnnnntggtgttgggggcagtccccctaagtccaagttactgtttagtaacacagcagctcaaaaattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaactttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaatcttgtgtatttttttttgttcctaatgattttatagacaaagactcttggcaaccccaggagaaaaaaaataaagctgtcagtggagtactagggatgagaatgaaactggaggtctgtttctggtattatggcttcccgggactctacagtcctgtatggtgaaatacatttttccattgggatcgtcaatgccatgactgttctgccacctcaaactccagagtttctggtgatgtgcaagagttagcaatatacattcagtaaagcgtgtaatcgagtaagtcgtagtaacttgggcgtaaagctctaccaccctgctcactaacaccctgatctccgtccggtatgaaaacacctattccgggtagtctggctccacgttaagcaaacaccactttccgtgttcaccgacagctagagccagaggtctcccggttgctgcttctgaggctgggtctgcagcagctgaggctcccgcctgtcttgccgaatggcctaagtctctgtcttgagactttcgagagttctaatcgtcaaatttcccattttattttgagattttccctgcggcccactatttcggacaacataggagagcctcaaaaacagtttctagcttccaactcggctcaaagttcagacagcagctgggcttccgagagccgccggtgttccaagaaaagctgcccgggactgggaggcgccctctggacgccggaacctttggtttcctgccgtggagcggaacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggtgtggcccctggtcccccgcagccggccgaccgcaaccgtgcgcctcaagctttccttccggggagaaacctaagctgcagccacccgggccgcgggacaaagtgcccgccgcgggcagggcaggggccggggaggagggggtagggaatggactgtgccgcggagcggccaggcagccctcttggcggaggatccagggaaagtgcggccccaccggccagctggcccccaggcggaaacggggcggcctccagcatgtgcccaccggcccgtcccacgcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaaggctggagtgcaatggcacgatctcggctcactgcgaccgccgcctcccaggttcaagcaattctcctgcctcagcctccctactagctgagattacagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctgggctgccggaacctttggtacttcggacagtccccccgatctggccggtgttggcttgggggttttcaccagaatgggcggattggggagtcttcccgccgacttttttgggaggccggtgtccggtttggccaccccggcaacaaagcacagcacgagagcggttagaacggcaaacgaaagggggccaggcacttatgggggggcccaagcagctcatacgacgctatttcttctttgttgctactcccttgttgcttctctaataacaacaagactaaatacaagacaacgaacagtaaagcacacaaaaaaaaagacaccagaagcaactaactaagacaacaaaacgacaaacaaacacaggcaaggcgacgagaccagacccacaaaaacaggacagacaggcagcgaggacagcagcgcaagaactgaaggcgacaggcagaagggcagcgcgagctaaccgaggaagcgcgcgaggccaccggcagagcgaggggagagacaggaggagatgcgcgcacagcagaaaagaacacgcgcgagaagagcggcctgacagacagaagcagaagggagagagaagacgaaaggacagcagggtagacagagagacgaagcagaacaacagggcaccgcagacaacggaaggggagcaagagacgagtaacgagggaggagacgcagagggagggcgaggcagacagacccaggcgggacgaagcgcgcgaagggaggcgcgagaggagccagaggaaagcagagggagcgaacgggcgaagcaagagagcaaggcaggacaggcgcgggacagggcgcggcagggcagcaagaagagaagagcgacagggaggcagcgacagagcacggaggcaacagcagcgaagcagagcaggaggagtgaaacgcaaggcaaagagacgaagagggaggccgagcaacgtaggcaggagagagcggcgggacactggagggaggagagagagacgggggcggagaaggagcagagagggagaggggagcgagaagagaggacagacgaagcgggcccaggaagaacgagaggcaacagacagaagggagagcagaagagccgagacacgagggcagaggaaaggagcacgcaagcgcgggagagaggcgagagagccgagaacaggagaaggcaggcacgagagaagcaagaggaggaagag

SEQ ID NO: 290244 - DNA, 2440 bp, Homo sapiens
  misc_feature (108)..(108): n is a, c, g, or t
  misc_feature (118)..(118): n is a, c, g, or t
  misc_feature (126)..(126): n is a, c, g, or t
  misc_feature (129)..(129): n is a, c, g, or t
  misc_feature (132)..(135): n is a, c, g, or t
tataagataaaacaaatcatgcatcattttattccagattgctcttgcccaaagaggtgatctctcagatgtggaggaagaggaagaagaagagatggatgtagatgnagccacaggngcagttangangcnnnntggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaactttttttttttttttttgtaaataaataaagcttggttcttacttaagga

SEQ ID NO: 290245 - DNA, 6698 bp, Homo sapiens
cctgggtgttgaatcggccgaggctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaactttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaatcttgtgtatttttttttgttcctaatgattttatagacaaagactcttggcaaccccaggagaaaaaaaataaagctgtcagtggagtactagggatgagaatgaaactggaggtctgtttctggtattatggcttcccgggactctacagtcctgtatggtgaaatacatttttccattgggatcgtcaatgccatgactgttctgccacctcaaactccagagtttctggtgatgtgcaagagttagcaatatacattcagtaaagcgtgtaatcgagtaagtcgtagtaacttgggcgtaaagctctaccaccctgctcactaacaccctgatctccgtccggtatgaaaacacctattccgggtagtctggctccacgttaagcaaacaccactttccgtgttcaccgacagctagagccagaggtctcccggttgctgcttctgaggctgggtctgcagcagctgaggctcccgcctgtcttgccgaatggcctaagtctctgtcttgagactttcgagagttctaatcgtcaaatttcccattttattttgagattttccctgcggcccactatttcggacaacataggagagcctcaaaaacagtttctagcttccaactcggctcaaagttcagacagcagctgggcttccgagagccgccggtgttccaagaaaagctgcccgggactgggaggcgccctctggacgccggaacctttggtttcctgccgtggagcggaacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggtgtggcccctggtcccccgcagccggccgaccgcaaccgtgcgcctcaagctttccttccggggagaaacctaagctgcagccacccgggccgcgggacaaagtgcccgccgcgggcagggcaggggccggggaggagggggtagggaatggactgtgccgcggagcggccaggcagccctcttggcggaggatccagggaaagtgcggccccaccggccagctggcccccaggcggaaacggggcggcctccagcatgtgcccaccggcccgtcccacgcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaaggctggagtgcaatggcacgatctcggctcactgcgaccgccgcctcccaggttcaagcaattctcctgcctcagcctccctactagctgagattacagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctgggctgccggaacctttggtacttcggacagtccccccgatctggccggtgttggcttgggggttttcaccagaatgggcggattggggagtcttcccgccgacttttttgggaggccggtgtccggtttggccaccccggcaacaaagcacagcacgagagcggttagaacggcaaacgaaagggggccaggcacttatgggggggcccaagcagctcatacgacgctatttcttctttgttgctactcccttgttgcttctctaataacaacaagactaaatacaagacaacgaacagtaaagcacacaaaaaaaaagacaccagaagcaactaactaagacaacaaaacgacaaacaaacacaggcaaggcgacgagaccagacccacaaaaacaggacagacaggcagcgaggacagcagcgcaagaactgaaggcgacaggcagaagggcagcgcgagctaaccgaggaagcgcgcgaggccaccggcagagcgaggggagagacaggaggagatgcgcgcacagcagaaaagaacacgcgcgagaagagcggcctgacagacagaagcagaagggagagagaagacgaaaggacagcagggtagacagagagacgaagcagaacaacagggcaccgcagacaacggaaggggagcaagagacgagtaacgagggaggagacgcagagggagggcgaggcagacagacccaggcgggacgaagcgcgcgaagggaggcgcgagaggagccagaggaaagcagagggagcgaacgggcgaagcaagagagcaaggcaggacaggcgcgggacagggcgcggcagggcagcaagaagagaagagcgacagggaggcagcgacagagcacggaggcaacagcagcgaagcagagcaggaggagtgaaacgcaaggcaaagagacgaagagggaggccgagcaacgtaggcaggagagagcggcgggacactggagggaggagagagagacgggggcggagaaggagcagagagggagaggggagcgagaagagaggacagacgaagcgggcccaggaagaacgagaggcaacagacagaagggagagcagaagagccgagacacgagggcagaggaaaggagcacgcaagcgcgggagagaggcgagagagccgagaacaggagaaggcaggcacgagagaagcaagaggaggaagag

SEQ ID NO: 290246 - DNA, 2575 bp, Homo sapiens
  misc_feature (108)..(108): n is a, c, g, or t
  misc_feature (118)..(118): n is a, c, g, or t
  misc_feature (126)..(126): n is a, c, g, or t
  misc_feature (129)..(129): n is a, c, g, or t
  misc_feature (132)..(135): n is a, c, g, or t
tataagataaaacaaatcatgcatcattttattccagattgctcttgcccaaagaggtgatctctcagatgtggaggaagaggaagaagaagagatggatgtagatgnagccacaggngcagttangangcnnnntggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaacagtcttatcatcttttgtgcatgacatacgcttggatcttacttaaaaaactcaaaggacctggcggagctttatatacctctagaggagcccgatcagccttcggggggccccggtcaccctatcacccttaggtgagcctattaccagcatcttgaccggactcttatgaaggctacactgag

SEQ ID NO: 290247 - DNA, 6251 bp, Homo sapiens
gcgccgatgccatggtagctgaaaccagtaagtgcatcatgtggtaaagcactagtagggcctgttgccgcatgtaccatcatcctgtaatacatacaccctgcattgcgtgatctttagactctatcgtgtcatctccgaactatgattcgcagccctttacctgtcaatccagaccagattacatatgaccatgtgtgtgcgtcgatctgtttctgggccttctgtccatcagtcactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaactttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaatcttgtgtatttttttttgttcctaatgattttatagacaaagactcttggcaaccccaggagaaaaaaaataaagctgtcagtggagtactagggatgagaatgaaactggaggtctgtttctggtattatggcttcccgggactctacagtcctgtatggtgaaatacatttttccattgggatcgtcaatgccatgactgttctgccacctcaaactccagagtttctggtgatgtgcaagagttagcaatatacattcagtaaagcgtgtaatcgagtaagtcgtagtaacttgggcgtaaagctctaccaccctgctcactaacaccctgatctccgtccggtatgaaaacacctattccgggtagtctggctccacgttaagcaaacaccactttccgtgttcaccgacagctagagccagaggtctcccggttgctgcttctgaggctgggtctgcagcagctgaggctcccgcctgtcttgccgaatggcctaagtctctgtcttgagactttcgagagttctaatcgtcaaatttcccattttattttgagattttccctgcggcccactatttcggacaacataggagagcctcaaaaacagtttctagcttccaactcggctcaaagttcagacagcagctgggcttccgagagccgccggtgttccaagaaaagctgcccgggactgggaggcgccctctggacgccggaacctttggtttcctgccgtggagcggaacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggtgtggcccctggtcccccgcagccggccgaccgcaaccgtgcgcctcaagctttccttccggggagaaacctaagctgcagccacccgggccgcgggacaaagtgcccgccgcgggcagggcaggggccggggaggagggggtagggaatggactgtgccgcggagcggccaggcagccctcttggcggaggatccagggaaagtgcggccccaccggccagctggcccccaggcggaaacggggcggcctccagcatgtgcccaccggcccgtcccacgcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaaggctggagtgcaatggcacgatctcggctcactgcgaccgccgcctcccaggttcaagcaattctcctgcctcagcctccctactagctgagattacagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctgggctgccggaacctttggtacttcggacagtccccccgatctggccggtgttggcttgggggttttcaccagaatgggcggattggggagtcttcccgccgacttttttgggaggccggtgtccggtttggccaccccggcaacaaagcacagcacgagagcggttagaacggcaaacgaaagggggccaggcacttatgggggggcccaagcagctcatacgacgctatttcttctttgttgctactcccttgttgcttctctaataacaacaagactaaatacaagacaacgaacagtaaagcacacaaaaaaaaagacaccagaagcaactaactaagacaacaaaacgacaaacaaacacaggcaaggcgacgagaccagacccacaaaaacaggacagacaggcagcgaggacagcagcgcaagaactgaaggcgacaggcagaagggcagcgcgagctaaccgaggaagcgcgcgaggccaccggcagagcgaggggagagacaggaggagatgcgcgcacagcagaaaagaacacgcgcgagaagagcggcctgacagacagaagcagaagggagagagaagacgaaaggacagcagggtagacagagagacgaagcagaacaacagggcaccgcagacaacggaaggggagcaagagacgagtaacgagggaggagacgcagagggagggcgaggcagacagacccaggcgggacgaagcgcgcgaagggaggcgcgagaggagccagaggaaagcagagggagcgaacgggcgaagcaagagagcaaggcaggacaggcgcgggacagggcgcggcagggcagcaagaagagaagagcgacagggaggcagcgacagagcacggaggcaacagcagcgaagcagagcaggaggagtgaaacgcaaggcaaagagacgaagagggaggccgagcaacgtaggcaggagagagcggcgggacactggagggaggagagagagacgggggcggagaaggagcagagagggagaggggagcgagaagagaggacagacgaagcgggcccaggaagaacgagaggcaacagacagaagggagagcagaagagccgagacacgagggcagaggaaaggagcacgcaagcgcgggagagaggcgagagagccgagaacaggagaaggcaggcacgagagaagcaagaggaggaagag

SEQ ID NO: 290248 - DNA, 1561 bp, Homo sapiens
  misc_feature (108)..(108): n is a, c, g, or t
  misc_feature (118)..(118): n is a, c, g, or t
  misc_feature (126)..(126): n is a, c, g, or t
  misc_feature (129)..(129): n is a, c, g, or t
  misc_feature (132)..(135): n is a, c, g, or t
tataagataaaacaaatcatgcatcattttattccagattgctcttgcccaaagaggtgatctctcagatgtggaggaagaggaagaagaagagatggatgtagatgnagccacaggngcagttangangcnnnntggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtatcctaactaattcattgccatatccgttaacacaagtatcgatctgaggttttgcttgatattattgttgtctggaatgtttaagctatgggtattgtttggagacttgttcagtgaaaatt

SEQ ID NO: 290249 - DNA, 937 bp, Homo sapiens
  misc_feature (108)..(108): n is a, c, g, or t
  misc_feature (118)..(118): n is a, c, g, or t
  misc_feature (126)..(126): n is a, c, g, or t
  misc_feature (129)..(129): n is a, c, g, or t
  misc_feature (132)..(135): n is a, c, g, or t
  misc_feature (902)..(902): n is a, c, g, or t
tataagataaaacaaatcatgcatcattttattccagattgctcttgcccaaagaggtgatctctcagatgtggaggaagaggaagaagaagagatggatgtagatgnagccacaggngcagttangangcnnnntggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcactccagaggatatatgctgataaagcagctgacatcattgatggtctgagaaagaatccctccattgctgttccaattgtccttaaaaggttgaagatgaaagaggaagaatggcgagaagctcagagaggctntaacaaagtatggcgagaacaaaatgagaaatact

SEQ ID NO: 290250 - DNA, 5554 bp, Homo sapiens
  misc_feature (108)..(108): n is a, c, g, or t
  misc_feature (118)..(118): n is a, c, g, or t
  misc_feature (126)..(126): n is a, c, g, or t
  misc_feature (129)..(129): n is a, c, g, or t
  misc_feature (132)..(135): n is a, c, g, or t
tataagataaaacaaatcatgcatcattttattccagattgctcttgcccaaagaggtgatctctcagatgtggaggaagaggaagaagaagagatggatgtagatgnagccacaggngcagttangangcnnnntggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaactttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaatcttgtgtatttttttttgttcctaatgattttatagacaaagactcttggcaaccccaggagaaaaaaaataaagctgtcagtggagtactagggatgagaatgaaactggaggtctgtttctggtattatggcttcccgggactctacagtcctgtatggtgaaatacatttttccattgggatcgtcaatgccatgactgttctgccacctcaaactccagagtttctggtgatgtgcaagagttagcaatatacattcagtaaagcgtgtaatcgagtaagtcgtagtaacttgggcgtaaagctctaccaccctgctcactaacaccctgatctccgtccggtatgaaaacacctattccgggtagtctggctccacgttaagcaaacaccactttccgtgttcaccgacagctagagccagaggtctcccggttgctgcttctgaggctgggtctgcagcagctgaggctcccgcctgtcttgccgaatggcctaagtctctgtcttgagactttcgagagttctaatcgtcaaatttcccattttattttgagattttccctgcggcccactatttcggacaacataggagagcctcaaaaacagtttctagcttccaactcggctcaaagttcagacagcagctgggcttccgagagccgccggtgttccaagaaaagctgcccgggactgggaggcgccctctggacgccggaacctttggtttcctgccgtggagcggaacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggtgtggcccctggtcccccgcagccggccgaccgcaaccgtgcgcctcaagctttccttccggggagaaacctaagctgcagccacccgggccgcgggacaaagtgcccgccgcgggcagggcaggggccggggaggagggggtagggaatggactgtgccgcggagcggccaggcagccctcttggcggaggatccagggaaagtgcggccccaccggccagctggcccccaggcggaaacggggcggcctccagcatgtgcccaccggcccgtcccacgcaggctttttggggccagctgccctgtggctgtgctctccagcttcctgacgccggagagacttccctaccaggaggcagtccagcgggacttccgccccgcgcaggtcggcgacagcttcggacccacgtaggtaacgcccagcgggtgggcggggccacaggcctaggggaagtcccaacccagctcccagccacaccttcgttgtctgccctctgccgtagacaactacgtgggatcgagcagcaccctctgctgggagcagcaccctctgctgggaacagctctctggtccctgggtcttcaggggatggttttcattcccacgtggccgcctctggacatcccttaggaagggcaccctagggatcacgaacctttgacg

SEQ ID NO: 290251 - DNA, 5543 bp, Homo sapiens
  misc_feature (108)..(108): n is a, c, g, or t
  misc_feature (118)..(118): n is a, c, g, or t
  misc_feature (126)..(126): n is a, c, g, or t
  misc_feature (129)..(129): n is a, c, g, or t
  misc_feature (132)..(135): n is a, c, g, or t
tataagataaaacaaatcatgcatcattttattccagattgctcttgcccaaagaggtgatctctcagatgtggaggaagaggaagaagaagagatggatgtagatgnagccacaggngcagttangangcnnnntggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaactttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaatcttgtgtatttttttttgttcctaatgattttatagacaaagactcttggcaaccccaggagaaaaaaaataaagctgtcagtggagtactagggatgagaatgaaactggaggtctgtttctggtattatggcttcccgggactctacagtcctgtatggtgaaatacatttttccattgggatcgtcaatgccatgactgttctgccacctcaaactccagagtttctggtgatgtgcaagagttagcaatatacattcagtaaagcgtgtaatcgagtaagtcgtagtaacttgggcgtaaagctctaccaccctgctcactaacaccctgatctccgtccggtatgaaaacacctattccgggtagtctggctccacgttaagcaaacaccactttccgtgttcaccgacagctagagccagaggtctcccggttgctgcttctgaggctgggtctgcagcagctgaggctcccgcctgtcttgccgaatggcctaagtctctgtcttgagactttcgagagttctaatcgtcaaatttcccattttattttgagattttccctgcggcccactatttcggacaacataggagagcctcaaaaacagtttctagcttccaactcggctcaaagttcagacagcagctgggcttccgagagccgccggtgttccaagaaaagctgcccgggactgggaggcgccctctggacgccggaacctttggtttcctgccgtggagcggaacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctactatttttcaaccaaatcaacaacaacctatccagctgttccccaaacatttacctccgaccccactaacaaccccacctcctaatactcactacctgaatccataccctcacaatcatggcaagccaacgccaacttatccagttgaaccactatcacgacaaaacactctacctctctatactaatctccctacaaatctccttcaactcataacacttcacaggcacagacactaatcatactcccatactctacttcaaaaacaaaaattatccccaccatagcgctactcatcaccctgatgaggccaccagcccacaa

SEQ ID NO: 290252 - DNA, 3297 bp, Homo sapiens
  misc_feature (108)..(108): n is a, c, g, or t
  misc_feature (118)..(118): n is a, c, g, or t
  misc_feature (126)..(126): n is a, c, g, or t
  misc_feature (129)..(129): n is a, c, g, or t
  misc_feature (132)..(135): n is a, c, g, or t
tataagataaaacaaatcatgcatcattttattccagattgctcttgcccaaagaggtgatctctcagatgtggaggaagaggaagaagaagagatggatgtagatgnagccacaggngcagttangangcnnnntggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaactttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccagtgtgggtcataaagcgagacactgtctttaaacaaaaaaa

SEQ ID NO: 290253 - DNA, 2239 bp, Homo sapiens
  misc_feature (108)..(108): n is a, c, g, or t
  misc_feature (118)..(118): n is a, c, g, or t
  misc_feature (126)..(126): n is a, c, g, or t
  misc_feature (129)..(129): n is a, c, g, or t
  misc_feature (132)..(135): n is a, c, g, or t
tataagataaaacaaatcatgcatcattttattccagattgctcttgcccaaagaggtgatctctcagatgtggaggaagaggaagaagaagagatggatgtagatgnagccacaggngcagttangangcnnnntggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagca

SEQ ID NO: 290254 - DNA, 5822 bp, Homo sapiens
acaggaaacagcaaagaccaaagaagacagaaatcgagctcggaacccccaggtagacataacctggatcgatgacctcagggcggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaactttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaatcttgtgtatttttttttgttcctaatgattttatagacaaagactcttggcaaccccaggagaaaaaaaataaagctgtcagtggagtactagggatgagaatgaaactggaggtctgtttctggtattatggcttcccgggactctacagtcctgtatggtgaaatacatttttccattgggatcgtcaatgccatgactgttctgccacctcaaactccagagtttctggtgatgtgcaagagttagcaatatacattcagtaaagcgtgtaatcgagtaagtcgtagtaacttgggcgtaaagctctaccaccctgctcactaacaccctgatctccgtccggtatgaaaacacctattccgggtagtctggctccacgttaagcaaacaccactttccgtgttcaccgacagctagagccagaggtctcccggttgctgcttctgaggctgggtctgcagcagctgaggctcccgcctgtcttgccgaatggcctaagtctctgtcttgagactttcgagagttctaatcgtcaaatttcccattttattttgagattttccctgcggcccactatttcggacaacataggagagcctcaaaaacagtttctagcttccaactcggctcaaagttcagacagcagctgggcttccgagagccgccggtgttccaagaaaagctgcccgggactgggaggcgccctctggacgccggaacctttggtttcctgccgtggagcggaacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggtgtggcccctggtcccccgcagccggccgaccgcaaccgtgcgcctcaagctttccttccggggagaaacctaagctgcagccacccgggccgcgggacaaagtgcccgccgcgggcagggcaggggccggggaggagggggtagggaatggactgtgccgcggagcggccaggcagccctcttggcggaggatccagggaaagtgcggccccaccggccagctggcccccaggcggaaacggggcggcctccagcatgtgcccaccggcccgtcccacgcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaaggctggagtgcaatggcacgatctcggctcactgcgaccgccgcctcccaggttcaagcaattctcctgcctcagcctccctactagctgagattacagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctgggctgccggaacctttggtacttcggacagtccccccgatctggccggtgttggcttgggggttttcaccagaatgggcggattggggagtcttcccgccgacttttttgggaggccggtgtccggtttggccaccccggcaacaaagcacagcacgagagcggttagaacggcaaacgaaagggggccaggcacttatgggggggcccaagcagctcatacgacgctatttcttctttgttgctactcccttgttgcttctctaataacaacaagactaaatacaagacaacgaacagtaaagcacacaaaaaaaaagacaccagaagcaactaactaagacaacaaaacgacaaacaaacacaggcaaggcgacgagaccagacccacaaaaacaggacagacaggcagcgaggacagcagcgcaagaactgaaggcgacaggcagaagggcagcgcgagctaaccgaggaagcgcgcgaggccaccggcagagcgaggggagagacaggaggagatgcgcgcacagcagaaaagaacacgcgcgagaagagcggcctgacagacagaagcagaagggagagagaagacgaaaggacagcagggtagacagagagacgaagcagaacaacagggcaccgcagacaacggaaggggagcaagagacgagtaacgagggaggagacgcagagggagggcgaggcagacagacccaggcgggacgaagcgcgcgaagggaggcgcgagaggagccagaggaaagcagagggagcgaacgggcgaagcaagagagcaaggcaggacaggcgcgggacagggcgcggcagggcagcaagaagagaagagcgacagggaggcagcgacagagcacggaggcaacagcagcgaagcagagcaggaggagtgaaacgcaaggcaaagagacgaagagggaggccgagcaacgtaggcaggagagagcggcgggacactggagggaggagagagagacgggggcggagaaggagcagagagggagaggggagcgagaagagaggacagacgaagcgggcccaggaagaacgagaggcaacagacagaagggagagcagaagagccgagacacgagggcagaggaaaggagcacgcaagcgcgggagagaggcgagagagccgagaacaggagaaggcaggcacgagagaagcaagaggaggaagag

SEQ ID NO: 290255 - DNA, 1674 bp, Homo sapiens
  misc_feature (108)..(108): n is a, c, g, or t
  misc_feature (118)..(118): n is a, c, g, or t
  misc_feature (126)..(126): n is a, c, g, or t
  misc_feature (129)..(129): n is a, c, g, or t
  misc_feature (132)..(135): n is a, c, g, or t
tataagataaaacaaatcatgcatcattttattccagattgctcttgcccaaagaggtgatctctcagatgtggaggaagaggaagaagaagagatggatgtagatgnagccacaggngcagttangangcnnnntggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcaggtgagaaccagtaactgaaatttctgtacacatctcccaccctagctaggaccaggggaggcccagagtcttctgattgtttttctttgtttatgcaaacctgttcttggagctgagacttaactgaggaagtacgtatgttggttgctaaggatcctgtgacaaagtaccacagactgtggcttaaatgacaaaagttgtggagactagaagtccaaagtcaagtgtcagcagtgttggttccttttgaggactgtgagggacaatctcttctaggcctctcctagcttctggttctttgctggcaatctttggcattcctgggcttgtagatccctgccttcatcttcatatggtgttcctacctgtgtgtgtgtgtctgcctccagatgaggtcacattcggaagtactgggggctaggacttcaatgtatgattttttgtttgtttgtttgagacagagtctcacctgacacagcctctcaaagtgctagcattacaggcgtgagcca

SEQ ID NO: 290256 - DNA, 1766 bp, Homo sapiens
gaagatgctacggcctgccacgaccacctgggctgcgtcgcggcacacactgatggcattggcgggagcatccaggtggcagtgcatggtgcggcctgtcagcacgctgccacccagggctgtggtcacacgggacatcttctccatggctgcacaggaatgggaggtcctctgccttccatgtagtcactgctgtttccattctaccatgtcggcatccagcctctacccctttgttgcaagaaagaataaatctgataagaggtacaggagaatcccgagacctgggatgcgcagggcagatatgcccacctacaccgctgtctggggacctaaaaacaactcagacacatgtttttacaacttttttaatatatatttttataaacaggtcacgtgataaaatagcacaagaaacacttaccaaatataaggttatatcttccgcatatacaggagaatgaggtcgttatgtacaataagaaaatgattttaggggttggttggttttgttttcctctctccccttaatttttcctcctacagtcgttggaaatatcacagcttcagttgcattaatactttgggcaaatggacagctgcccctccccactaggggttgtggggaggaggggctggagaaactggctcctgaccactcagccctggagcttcctggggctggcactccagggacaggaaaatctttgggctgttgatctgtttctgattcaacagcatctctctctctctttctctctctctctcactctctttctctctctcactctctggctctctggaaactggttactctcttccaaccagatagggagtgtcccaagattgggtgtgggcgcggtatctcctggggctcaaggttgggatgggaaggggtcccagccccctcctcagcaacagctgagatttgccagcatcccccaggacttccaaatgtctcgggccgacagagcacggtcagagcccatttgggcagacagaagtttgggaagctggggaggggtgaagtgggggtgggggggcaggctagaaaggagccctccctcctcggggtgtctagggtgtgctggccactggaagattggagtcgctgacccagtgctgaccctgacccttggctgggtccactctgcagactccacctgaggagacccacccagggtgaagctcggtgcccaggcctgaactgagcccggccgggtgcaagggctgaggtgtgaggtcggcccaggcctcttcccaggcctgagggtggctacagctcgaggcttgcaaggtgcctgcgccacccctgggttgaggccgaccggagtcagctgggatcacgttaatgactccaagcgatcgccagcccttccgccctctccctgcccaattctctcagcctggccagggaccaaggccgggttttggggcggacaggggactgccccacacagcggcaaggaggaggagaggccgcgtgggtcaggctggatgggtgaggaggtgcgggtggggcctgggctctcggcggcgggccatggctttggcggtggcctgtttcccctgacacccctcggagggctccaggtatggtgcggtggaagatgcaggaagcccgtggggctcttctgggcccgtgtcctgggggacccagccccctcaatcccactgggccctgcccgggatgggggggacagtgggaagacagagcgggtgtggcggggaaggcggtaagggcacagtctggagagctcaaagcc

SEQ ID NO: 290257 - DNA, 482 bp, Homo sapiens
accaccaccacaccctgttaattttttgtatttttagtagagacagggtttcaccatgttggccaggctggtcttgaacgcctgacctcaggtgatccacccgcttcggcctaagtgctaggattacaggcgtgagccactgtgcccagcctcagttgcctttttcgacctctctgtctctcctgggtgtgagccattgtctgctattggtgcattttgtaatcttttgcgacatccttgtccttgcctgttactgtgtatagaacagggtttatttctgcctctctggaagggtgggctagagtctggatatgttggagggaatattatgtgtagtgacttcagtgttgtctctccctttaaggaatgggaggtcctctgccttccatgtagtcactgctgtttccattctaccatgtcggcatccagcctctacccctttgttgcaagaaagaataaatctgataagaggtacaggagaa

SEQ ID NO: 290258 - DNA, 740 bp, Homo sapiens
atcggaactccaggtgctgggtcttccaggagcgcgcctgcgcgggagggtgaccacaggcggccgggcgggatgtcctgtccgcagtcttcagcccagccgccgccacccataagctatgaggaggagtttacgaccacctggactactaccacctgcgtgacttcccggcctgcggggtccgcgcagcaaaggcttgacgctgctggagcaggcgctgcgcacctactggctggcgcctggtaggcacgagcgcagggtcgcccagaagctcctcaatggcctgagcaagtaccagccagcgccagctgcagccctggccgcgcactcgcctcagctgagcctggattgaaagattccagagcaagaagttgaaagcacaaggcggtgaggcaccctgcgcaccgagagcaacctccccagccggcggctgcaggcgcatcccggaagcgggcagaggggcctcaggctctctcccgccagggcggagggccccatcccctttcccagcgcctccggcgtggccggcggttcagtgacctagcttgagccacgcaccaaccaggagcgacagcagggacagcagcggtgatgaacaacccatgctggcatcaggactggcgcgccacgccgcgcacacccacggccccgctgctcatccgccctcacgcaccacggtggcagtcgcctcctccacacatgcgcatgctgctccaccaccgcccctcacccaacggttc

SEQ ID NO: 290259 - DNA, 624 bp, Homo sapiens
ttaggggaggaacaggaagagaagagtgtggcctcctagaaatctagcacggagaaagactggtcttgaactcctgacctcgtgatactcagcctcccaaagtgctgggattacaggagtgaaccaccaagcccggcttgacctcttggcttttaccaaaggatgtttgcttctgaggaagctggaagctgcagccacaatgtgcctttgcaggggagcctgagagccacaggatggaatacaggggggacagttagattctgaattgttaagcagagctgcttgatgcagaagatgaagacacaagaaagaatgagcctaggccgggcacagtggctcacgcctgtaattccagcacttcgggaggccgaggcgggaggatcacttgagctcaggagtttgagaccggcctggccaccatggtgaaacctcgactctaccaaaaaaaaaaaaaaaaagccaaaattagccgggtgtggtggcatatgcctgtggtcccagctacttgggaggctgaagtgggagaatcacttgagcccaggaggctgcagttgcagtgagctgatattatgccactgcactccagcctgggtgacagggtgagaccctgtctcaaaaaaaaaa

SEQ ID NO: 290260 - DNA, 885 bp, Homo sapiens
  misc_feature (885)..(885): n is a, c, g, or t
atcggaactccaggtgctgggtcttccaggagcgcgcctgcgcgggagggtgaccacaggcggccgggcgggatgtcctgtccgcagtcttcagcccagccgccgccacccataagctatgaggaggagtttacgaccacctggactactaccacctgcgtgacttcccggcctgcggggtccgcgcagcaaaggcttgacgctgctggagcaggcgctgcgcacctactggctggcgcctggtaggcacgagcgcagggtcgcccagaagctcctcaatggcctgagcaagtaccagccagcgccagctgcagccctggccgcgcactcgcctcagctgagcctgggggaggaacaggaagagaagagtgtggcctcctagaaatctagcacggagaaagatttttcaccatcctgcctgtgctcctgaatacacactcaagctagaaacacagagccccgaacttaggacagtgatctggccggccactgcctagcaagactatcatctcaggaaacccagaccatgaaggcgagtaccttctaagagccagcactgcagctgatcaccaaattgggctagcttttgtgccttttggcacttgcttttaagatgcccaaccagggataccaacttggtcaacggcacaagacattcttaaactgttcacttaccgttggcggactgaagtccactgacacgtcagacacttcatttttaaccgtcggcgtcagtggcccaaacaaacttcaattacaggtgggcctccaagaagcttaacacactttggttgaagggacacacacagaaattgctccaccagggaggtctcgaccgcggactggaaatctccggtttaccagaggctggtgactgcccagaan

SEQ ID NO: 290261 - DNA, 791 bp, Homo sapiens
atcggaactccaggtgctgggtcttccaggagcgcgcctgcgcgggagggtgaccacaggcggccgggcgggatgtcctgtccgcagtcttcagcccagccgccgccacccataagctatgaggaggagtttacgaccacctggactactaccacctgcgtgacttcccggcctgcggggtccgcgcagcaaaggcttgacgctgctggagcaggcgctgcgcacctactggctggcgcctggtaggcacgagcgcagggtcgcccagaagctcctcaatggcctgagcaagtaccagccagcgccagctgcagccctggccgcgcactcgcctcagctgagcctgggggaggaacaggaagagaagagtgtggcctcctagaaatctagcacggagaaagatttttcaccatcctgcctgtgctcctgaatacacactcaagctagaaacacagagccccgaacttaggacagtgatctggccggccactgcctagcaagactatcatctcaggaaacccagaccatgaaggcgagtaccttctaagagccagcactgcagctgatcaccaaattgggctagcttttgtgccttttggcacttgctttagtgccaacaggataaaactgtcaaggacaaaatctaaatgtttatttacgtggggatgagtcaggaagtagactttattttactgggctcagggccaacaacctcattcagtggcctccaaaactaaacactttgttgagggagaagagaaatcgctccacaagagatatagaaaggactg

SEQ ID NO: 290262 - DNA, 718 bp, Homo sapiens
atcggaactccaggtgctgggtcttccaggagcgcgcctgcgcgggagggtgaccacaggcggccgggcgggatgtcctgtccgcagtcttcagcccagccgccgccacccataagctatgaggaggagtttacgaccacctggactactaccacctgcgtgacttcccggcctgcggggtccgcgcagcaaaggcttgacgctgctggagcaggcgctgcgcacctactggctggcgcctggtaggcacgagcgcagggtcgcccagaagctcctcaatggcctgagcaagtaccagccagcgccagctgcagccctggccgcgcactcgcctcagctgagcctgggaatgaagaagctgtttctttacacaatcgttatcccataatgcctgcttctgctgctaccacgggctcacctaaaaggcaaccaaagggaggaacaggaagagaagagtgtggcctcctagaaatctagcacggagaaagttactcatccttcaaaactcagttcagagatcagctcctccaagaaggcttctgtggttgtggttggtgctctttcctaccagtaccagctgtcctgagagcacgtctctacatctctagctgccttctggaaaccgggagaaagccaaaacggatgaccagacactagatcagccgtgtccaaccctgtgactacgacggacttttccgcctatctttggtgagacggg

SEQ ID NO: 290263 - DNA, 489 bp, Homo sapiens
atcggaactccaggtgctgggtcttccaggagcgcgcctgcgcgggagggtgaccacaggcggccgggcgggatgtcctgtccgcagtcttcagcccagccgccgccacccataagctatgaggaggagtttacgaccacctggactactaccacctgcgtgacttcccggcctgcggggtccgcgcagcaaaggcttgacgctgctggagcaggcgctgcgcacctactggctggcgcctggtaggcacgagcgcagggtcgcccagaagctcctcaatggcctgagcaagtaccagccagcgccagctgcagccctggccgcgcactcgcctcagctgagcctggctgaaggtttagaataaaatgggttatgtctggacccacttcaaaatggctccaggagacggggagagtgcgattccacaggagcaggactggccacaaactggcagctctttaaggtggcccacgagtacgtgagggcagg

SEQ ID NO: 290264 - DNA, 320 bp, Homo sapiens
cacctggccggcatgaggccaagatccccctctgcctctctcttttctttgtactctgctaatcaggtttacatgatttcctatcagacctgaatcttgcagaattgaagccacagaaaagaatatgctgactctgcagtgcttgaagggggtaaaactaaagcattacctagaggaagcagtcttaggaaattttgcctctgactcgtttttgtgacagtcccaccaggagagagtgaagccagtctccctctttcctgttttgtgtctggacttcaatgttcatttcctcattctctctttctaggatcttgctcttg

SEQ ID NO: 290265 - DNA, 483 bp, Homo sapiens
cagccttggcctcccagtgctgggattacaggcgtgaggcactgcgcccgcctgagtctgcttctgtgtctattcatttagttctcccaagagattctctttccctctccctctgcctctctcttttctttgtactctgctaatcaggtttacatgatttcctatcagacctgaatcttgcagaattgaagccacagaaaagaatatgctgactctgcagtgcttgaagggggtaaaactaaagcattacctagaggaagcagtcttaggaaattttgcctctgactcgtttttgtgacagtcccaccaggagagagtgaagccagtctccctctttcctgttttgtgtctggacttcaatgttcatttcctcattctctctttctaggatcttgctcttgcagaatctacaggtctttcttgaagaaatctgtagtcataattttgtgctccatttttatttaggggaggaacaggaagaga

SEQ ID NO: 290266 - DNA, 4635 bp, Homo sapiens
  misc_feature (3)..(3): n is a, c, g, or t
  misc_feature (2300)..(2300): n is a, c, g, or t
gangaaaactcacagggtgcgtcgctggtaacccatgctcccataaagcctggcctctggaaagagacttgggaacgagccctgacgttctcagccgtcgagcttcacagagaagggtagctcgaattaggttccttatcttaaagagaataacagcagtcactttctcacaatcttgcgaacgccaaatggaaggatccctcgagagcgctgagaactcgccgagctcctcccgggaaacccggtaccacgaggcgccattttgcggatgggcaaaccgaggcccgcggggccgcgacttacccaggcctttttgcagtgggaggcgacggtggaggagggtggtctgggaccgggacaacaaagtccatcctgccgccggcttcgacgcaggtgccagaaaggtcccaaccccgcccaggcagggcgaggcggcgcggcccaggaacctgtcatggcggcgccgctgcccgacgccggaagtgcccgcctggaactacagctcccagcagaccccgcggcgcgctccggtcgacgccggggaagcagccgccattgtccgcggctgaggtgaggcctttgctcaggctgtggggccgccgtagctgcggggcttggggggtcaggagagccggctgggagaggcggcgtcagggtgggtcctgcgcctgccctttccgcgccggctttgcgccgtcgttgccgtcggttctccagccagcagcctgcctccggcctcccgcctccgggcgttcttcgttttctggtcggacgggcctgggtgaactctgctgcacgtcggctccgcgggcctttgtccccgaggccgcgccgggagctcccaagcgcactcctgggccggacctcggcgcgggacaaaagccaaacgccccaggcgggcagaccccgatcctgctgcgccgccttcaagggggaccgccggccgcgagccaggttgggatttgctgtgttcctgggcaggtgcctggtcaatcagtcctcgggatggcagccatcaacccgtgggcctcctggggtgcccttacggaccaatcttgggggatgacagctgttgacccatgggcctcctgggctctgtgtcctcagtatcctgcctggcacgtggagggaagcctggaggaggggaggagggccactgggctcccagcagcccaggttcaggaaccagtgaccttcaaggacgtggccgtggacttcacccaagaagagtgggggcagctggaccttgttcagaggaccctgtaccgtgatgtgatgctggagacctatggtcacctgctctctgtgggaaatcagattgccaagcctgaggtcatctccctgttggagcaaggagaagagccgtggtcagtggagcaggcatgtcctcaacgcacttgtccagaatgggtgagaaatcttgaaagcaaagcattgatcccagcacagagcatttttgaggaagaacaatcccatggcatgaagttggaaagatatatatgggatgatccttggttctccaggttagaagttttgggatgtaaagaccaattagaaatgtaccacatgaaccagagtacagctatgaggcagatggtcttcatgcaaaagcaagtactatcccagagaagctctgaattctgtggacttggggcagagtttagccagaacttaaactttgttccatctcagagagtttctcagatagaacatttctataagcctgatacacatgctcaaagttggagatgtgactcagccataatgtatgcagataaggttacctgtgaaaataatgattatgacaaaactgtttatcagtccattcaacctatttaccctgcaagaatacaaactggagataatcttttcaaatgtactgatgctgttaaatctttcaatcatataatacattttggtgatcataaaggaattcacacaggagaaaaactctatgaatataaggaatgccatcaaatctttaaccagagcccatcatttaatgaacacccaaggcttcatgttggagaaaaccagtataattacaaagaatatgagaatatcttttatttctcatcctttatggaacatcaaaaaattggtactgtagagaaagcgtataaatacaatgaatgggagaaagtctttgggtatgactctttccttactcaacatacaagcacttacactgcagagaaaccctatgactgcaatgaatgtgggacgtctttcatctggagctcttaccttattcaacataagaaaactcatactggagaaaaaccctatgaatgtgatanatgtggaaaagtttttaggaatcgctcagcctttacgaaacatgaacggactcacactggaataaaaccctatgaatgtaataaatgtggaaaagccttcagctggaattctcatcttattgtacataagagaattcatacaggagaaaaaccttatgtttgtaatgagtgtgggaaatctttcaactggaactctcatcttattggacatcagaggactcatacaggagagaaaccttttgaatgtactgaatgtgggaaatcattcagctggagctcccatcttattgcccatatgagaatgcatactggagagaaaccctttaaatgtgatgaatgtgaaaaagcttttagggactactcagcccttagtaaacatgaaagaactcattctggagcaaaaccatataaatgtactgaatgtggaaaatccttcagctggagctcccatcttattgcccatcagagaactcacacgggagagaaaccatataactgtcaggaatgtggcaaagcattcagagaacgctcagccctcactaaacatgagataattcattctggaattaagccctatgaatgtaataaatgtggaaaatcctgtagccagatggctcaccttgttagacatcaaaggactcatactggagaaaaaccctatgaatgcaataaatgtggaaaatccttcagtcagagctgtcaccttgttgctcatcggagaattcacactggtgagaaaccctataaatgtaatcagtgtgaaagatcctttaactgtagttctcacctcattgcacaccggagaactcatactggagagaaaccatacaggtgtaatgaatgtgggaaagcatttaatgagagttcatcccttattgtacacctaagaaaccatactggagaaaagccctacaaatgtaatcattgtgaaaaagcattttgtaagaattcttcccttattattcatcagagaatgcatagtggagagaaacgctttatatgcagtgaatgtggaaaagcctttagtggtcactcagccctacttcaacaccagagaaatcacagtgaagagaaactgaattgaatttatgcgagtttttcgtttcttgtacatttgacaacacattgaggaaaaccctataaacataatcaagaggggacatttttcattaagagttcagtaagacttctcccacattatttactagaaaatatcatcttagaagaaaccccatgaaggaaaagaatagggaaaagctttcagcagttatttagcccttactcaaaatcagataattaacaatgaaggaaactctaaactccccttatggtctaccagtaattcatacttgaggaccatgactgtggggaatgaggcatcttttagcaagagctctcaccaattgtagattggtgtgaattgctaagggaaaaaccttatgcagagaaaagtttttgactggaaatacactgttttgcatcaagctggagtactggatggaaaactctacaataacattttgtgcataattgtagaaatacagattttgttgttataaggggagggtctgggtgcccaggagtagaatatgaagtgctaaatctgaatgtaagaaaaataatagtattgaatggggtatttactgttgattaacctccttagagaaaattaatgaatgagatgactaacggtagaaaagttattgcctaggagtgtgagactgatgttgctggacagaaagtgatccttagcccagtgtgtcagcgtccattgttactcatcactgcattgttgggcaattagtttgtaatttgttttaggcaatcactataaattataattatggacactgcatcagtatacataacatgaaggaataaaaaggatacagaattgtatatacatacttactgtaacacatctaaaaaaatgtatatgggtaaggacctgaaagatccatggaaaagttaacccagttgagatttttaaaaagttttacaaatacatataacacttatgtgctgggctttcttttaaatgctttccaagtgttaacttgtttagtcccctttactctgagataggtactgttaccccagttttacaaatggctaagctgaagcagagatgttgaaggatcctacctaaggggcacaactagtaagggagtagagctgagattggctccagagttcttgttttcagccaccattttatgctgcctctccagtgattttttttcccattttcttcagtgtttctatagcagagatttgataataaaaagaaaatcctaaacaatgagaaataaagttacctggtttctctgtcaaa

SEQ ID NO: 290267 - DNA, 1659 bp, Homo sapiens
  misc_feature (3)..(3): n is a, c, g, or t
gangaaaactcacagggtgcgtcgctggtaacccatgctcccataaagcctggcctctggaaagagacttgggaacgagccctgacgttctcagccgtcgagcttcacagagaagggtagctcgaattaggttccttatcttaaagagaataacagcagtcactttctcacaatcttgcgaacgccaaatggaaggatccctcgagagcgctgagaactcgccgagctcctcccgggaaacccggtaccacgaggcgccattttgcggatgggcaaaccgaggcccgcggggccgcgacttacccaggcctttttgcagtgggaggcgacggtggaggagggtggtctgggaccgggacaacaaagtccatcctgccgccggcttcgacgcaggtgccagaaaggtcccaaccccgcccaggcagggcgaggcggcgcggcccaggaacctgtcatggcggcgccgctgcccgacgccggaagtgcccgcctggaactacagctcccagcagaccccgcggcgcgctccggtcgacgccggggaagcagccgccattgtccgcggctgaggtgaggcctttgctcaggctgtggggccgccgtagctgcggggcttggggggtcaggagagccggctgggagaggcggcgtcagggtgggtcctgcgcctgccctttccgcgccggctttgcgccgtcgttgccgtcggttctccagccagcagcctgcctccggcctcccgcctccgggcgttcttcgttttctggtcggacgggcctgggtgaactctgctgcacgtcggctccgcgggcctttgtccccgaggccgcgccgggagctcccaagcgcactcctgggccggacctcggcgcgggacaaaagccaaacgccccaggcgggcagaccccgatcctgctgcgccgccttcaagggggaccgccggccgcgagccaggttgggatttgctgtgttcctgggcaggtgcctggtcaatcagtcctcgggatggcagccatcaacccgtgggcctcctggggtgcccttacggaccaatcttgggggatgacagctgttgacccatgggcctcctggggtgagtcaagagcctggtcagctgtgggctgccatattgtggcctctggctgtagtgctctgccacagctggggaatagaatggggaccaggtggggctttagggcaggtggtccagatctgtctctgtgcagagctggaacaaggaggaatcagaaaactagtggccaggcgtggtgactcacgcctacagcactttgggaggccgaggcgagtggatcacgaggtcaggagatcgagaccatcctggctaacacggtgaaaccccgtctctactaaaacaaaatacaaaaaattagctgggcgtggtggtgggcgcctgtagtcccagctgctcgggaggctgaggcaggagaatggcgtgaagccaggaggcggagcgtgcagtgagccaagatcgtgccactgcactccagcctgggcgacagagcgagactcagtctccagaaagacagaaaaatcgcggggggggccggaccaattgcgccggggcggtacaaccacggcggggtatcgcgtgcggacacactgggcccaccgctcccgggacaccctcccgcgcgggcc

SEQ ID NO: 290268 - DNA, 4251 bp, Homo sapiens
  misc_feature (3)..(3): n is a, c, g, or t
  misc_feature (1916)..(1916): n is a, c, g, or t
gangaaaactcacagggtgcgtcgctggtaacccatgctcccataaagcctggcctctggaaagagacttgggaacgagccctgacgttctcagccgtcgagcttcacagagaagggtagctcgaattaggttccttatcttaaagagaataacagcagtcactttctcacaatcttgcgaacgccaaatggaaggatccctcgagagcgctgagaactcgccgagctcctcccgggaaacccggtaccacgaggcgccattttgcggatgggcaaaccgaggcccgcggggccgcgacttacccaggcctttttgcagtgggaggcgacggtggaggagggtggtctgggaccgggacaacaaagtccatcctgccgccggcttcgacgcaggtgccagaaaggtcccaaccccgcccaggcagggcgaggcggcgcggcccaggaacctgtcatggcggcgccgctgcccgacgccggaagtgcccgcctggaactacagctcccagcagaccccgcggcgcgctccggtcgacgccggggaagcagccgccattgtccgcggctgaggttgggatttgctgtgttcctgggcaggtgcctggtcaatcagtcctcgggatggcagccatcaacccgtgggcctcctggggtgcccttacggaccaatcttgggggatgacagctgttgacccatgggcctcctgggctctgtgtcctcagtatcctgcctggcacgtggagggaagcctggaggaggggaggagggccactgggctcccagcagcccaggttcaggaaccagtgaccttcaaggacgtggccgtggacttcacccaagaagagtgggggcagctggaccttgttcagaggaccctgtaccgtgatgtgatgctggagacctatggtcacctgctctctgtgggaaatcagattgccaagcctgaggtcatctccctgttggagcaaggagaagagccgtggtcagtggagcaggcatgtcctcaacgcacttgtccagaatgggtgagaaatcttgaaagcaaagcattgatcccagcacagagcatttttgaggaagaacaatcccatggcatgaagttggaaagatatatatgggatgatccttggttctccaggttagaagttttgggatgtaaagaccaattagaaatgtaccacatgaaccagagtacagctatgaggcagatggtcttcatgcaaaagcaagtactatcccagagaagctctgaattctgtggacttggggcagagtttagccagaacttaaactttgttccatctcagagagtttctcagatagaacatttctataagcctgatacacatgctcaaagttggagatgtgactcagccataatgtatgcagataaggttacctgtgaaaataatgattatgacaaaactgtttatcagtccattcaacctatttaccctgcaagaatacaaactggagataatcttttcaaatgtactgatgctgttaaatctttcaatcatataatacattttggtgatcataaaggaattcacacaggagaaaaactctatgaatataaggaatgccatcaaatctttaaccagagcccatcatttaatgaacacccaaggcttcatgttggagaaaaccagtataattacaaagaatatgagaatatcttttatttctcatcctttatggaacatcaaaaaattggtactgtagagaaagcgtataaatacaatgaatgggagaaagtctttgggtatgactctttccttactcaacatacaagcacttacactgcagagaaaccctatgactgcaatgaatgtgggacgtctttcatctggagctcttaccttattcaacataagaaaactcatactggagaaaaaccctatgaatgtgatanatgtggaaaagtttttaggaatcgctcagcctttacgaaacatgaacggactcacactggaataaaaccctatgaatgtaataaatgtggaaaagccttcagctggaattctcatcttattgtacataagagaattcatacaggagaaaaaccttatgtttgtaatgagtgtgggaaatctttcaactggaactctcatcttattggacatcagaggactcatacaggagagaaaccttttgaatgtactgaatgtgggaaatcattcagctggagctcccatcttattgcccatatgagaatgcatactggagagaaaccctttaaatgtgatgaatgtgaaaaagcttttagggactactcagcccttagtaaacatgaaagaactcattctggagcaaaaccatataaatgtactgaatgtggaaaatccttcagctggagctcccatcttattgcccatcagagaactcacacgggagagaaaccatataactgtcaggaatgtggcaaagcattcagagaacgctcagccctcactaaacatgagataattcattctggaattaagccctatgaatgtaataaatgtggaaaatcctgtagccagatggctcaccttgttagacatcaaaggactcatactggagaaaaaccctatgaatgcaataaatgtggaaaatccttcagtcagagctgtcaccttgttgctcatcggagaattcacactggtgagaaaccctataaatgtaatcagtgtgaaagatcctttaactgtagttctcacctcattgcacaccggagaactcatactggagagaaaccatacaggtgtaatgaatgtgggaaagcatttaatgagagttcatcccttattgtacacctaagaaaccatactggagaaaagccctacaaatgtaatcattgtgaaaaagcattttgtaagaattcttcccttattattcatcagagaatgcatagtggagagaaacgctttatatgcagtgaatgtggaaaagcctttagtggtcactcagccctacttcaacaccagagaaatcacagtgaagagaaactgaattgaatttatgcgagtttttcgtttcttgtacatttgacaacacattgaggaaaaccctataaacataatcaagaggggacatttttcattaagagttcagtaagacttctcccacattatttactagaaaatatcatcttagaagaaaccccatgaaggaaaagaatagggaaaagctttcagcagttatttagcccttactcaaaatcagataattaacaatgaaggaaactctaaactccccttatggtctaccagtaattcatacttgaggaccatgactgtggggaatgaggcatcttttagcaagagctctcaccaattgtagattggtgtgaattgctaagggaaaaaccttatgcagagaaaagtttttgactggaaatacactgttttgcatcaagctggagtactggatggaaaactctacaataacattttgtgcataattgtagaaatacagattttgttgttataaggggagggtctgggtgcccaggagtagaatatgaagtgctaaatctgaatgtaagaaaaataatagtattgaatggggtatttactgttgattaacctccttagagaaaattaatgaatgagatgactaacggtagaaaagttattgcctaggagtgtgagactgatgttgctggacagaaagtgatccttagcccagtgtgtcagcgtccattgttactcatcactgcattgttgggcaattagtttgtaatttgttttaggcaatcactataaattataattatggacactgcatcagtatacataacatgaaggaataaaaaggatacagaattgtatatacatacttactgtaacacatctaaaaaaatgtatatgggtaaggacctgaaagatccatggaaaagttaacccagttgagatttttaaaaagttttacaaatacatataacacttatgtgctgggctttcttttaaatgctttccaagtgttaacttgtttagtcccctttactctgagataggtactgttaccccagttttacaaatggctaagctgaagcagagatgttgaaggatcctacctaaggggcacaactagtaagggagtagagctgagattggctccagagttcttgttttcagccaccattttatgctgcctctccagtgattttttttcccattttcttcagtgtttctatagcagagatttgataataaaaagaaaatcctaaacaatgagaaataaagttacctggtttctctgtcaaa

SEQ ID NO: 290269 - DNA, 3066 bp, Homo sapiens
cggtggattaagggtcagggccggtggctgtgggaggtgacactgagccgctcctcagcccctcctcccatccccaacgcgcacaacacatgcatttcaaatggtaaaaggcttaaaaacagcttgtatagaatattcttttttaaatagattaaggttgaaattgtctgaaatcaggtctgtaaatttccttaagacctaccttggcataaaggctgacccagcaaaagaactgagaaatacagcctgagatggacagcagtaattgcaaagttattgctcctctcctaagtcaaagataccggaggatggtcaccaaggatggccacagcacacttcaaatggatggcgctcaaagaggtcttgcatatcttcgagatgcttggggaatcctaatggacatgcgctggcgttggatgatgttggtcttttctgcttcttttgttgtccactggcttgtctttgcagtgctctggtatgttctggctgagatgaatggtgatctggaactagatcatgatgccccacctgaaaaccacactatctgtgtcaagtatatcaccagtttcacagctgcattctccttctccctggagacacaactcacaattggttatggtaccatgttccccagtggtgactgtccaagtgcaatcgccttacttgccatacaaatgctcctaggcctcatgctagaggcttttatcacaggtgcttttgtggcgaagattgcccggccaaaaaatcgagctttttcaattcgctttactgacacagcagtagtagctcacatggatggcaaacctaatcttatcttccaagtggccaacacccgacctagccctctaaccagtgtccgggtctcagctgtactctatcaggaaagagaaaatggcaaactctaccagaccagtgtggatttccaccttgatggcatcagttctgacgaatgtccattcttcatctttccactaacgtactatcactccattacaccatcaagtcctctggctactctgctccagcatgaaaatccttctcactttgaattagttgtattcctttcagcaatgcaggagggcactggagaaatatgccaaaggaggacatcctacctaccgtctgaaatcatgttacatcactgttttgcatctctgttgacccgaggttccaaaggtgaatatcaaatcaagatggagaattttgacaagactgtccctgaatttccaactcctctggtttctaaaagcccaaacaggactgacctggatatccacatcaatggacaaagcattgacaattttcagatctctgaaacaggactgacagaataagacttatccattttttaatgtattaaatacacccagccagttatgcagctactttttctttactgtatctcatgttttcttttttcaatgctaattatagctctctacatcacggtaatcatgcctatgcctacataagaatggctgagctaacaatacacattctggaaacataacactctacattacaaagtttgttacctgctgaaatcaatgtaactcaacttgacagacacttatacagaaatgttgctggtgaatttataagaatgtggtatgatactagtaatgaaggcaaaatggacagtgaagtttaacacaactgaactctaagaaaatcaaccattaatctctcattttcatctgcaaattgaagcaacagtttagtttcaaacctagctccctgggtggaatgacgacttcactatacttagtgaatatcctttaagagctgggatttttttcaagacaacaaagatcattcatttggttctttatactatgaaacttgagtaagtattacctccttaatttttaacaactaagaacaaaaattaacgagaaaaacaacaaagtacagatttatacataaacctaaaagcatttgaacatgacacccgaacacatacatatatgttcacttatttgtggcagaaggtgatcagataagctccagcccaaatggaacctgtggggtggtattttgcattgcaaggagacgcaaaattttattttaaaactgtcctccataataatcaaacggtgattcatctaaatgacttctagcaacctaagtaaaaacattcccctcctatgtatgattcatttgatcatataaaacatcatgatggctctaattcataaatacaaaaatatatttaagtctttatagatataaagctttacttagatataacttgagtgagtagggaaaaaaatctacagtagataaagcaaaagataattaggcaacaaagcattttcaaactcaaattcctgtttccaacttcaaatagttttttctataaacacaaaatcagtgtttattcaccagtaggaggttggactagatgaactctattatttctttctaaatctaatagtctataaaaattatgtttcctctgttttttattttatctatgctaaaatgagccctttcccttatgtccagtttaagatgatcatttgcatgattttcatttcaataaaaaaaagagaaactgtccttaaaacaaaacaaaaaccaaaaaagtcaccctatcaggtttcaaacagatttgtggctgttcttttctgaaatttcccttattcaggtttctgtgggaaaaatgaaagattaaccttccccactggtgatgacctaggcaggaatcatctcttgaaataaatactagctgagtaaaggcaagcaggtgtgaagagcagggctcagcagcaagtcacatttttctactatttgaccaaaaggaaaagaaaataaagaagaactctggagtggtctaagactgataatagcagaagaatatcaagaacacagaaacttaattattgtgaacttttgctgtttgaaaatcttagacattcattcttaagtagaaatcagaccaacagattttcccaacccaagactattgtaacacataaagacagcaagaattcttatttctataataaattaacaagattcacctaacctttgaaaataaagtagtattgaagacttaaaaaa

SEQ ID NO: 290270 - DNA, 3892 bp, Homo sapiens
  misc_feature (1910)..(1910): n is a, c, g, or t
  misc_feature (2382)..(2382): n is a, c, g, or t
cttttagagacagggtctcgctatgttggccagatcggtcttgaattcccgacctcaagcaatcctcccgactcaacgtcccaaagtgctagtgttacaggcatgagtcaccatgcctggttcctcactttcgttatctgtaaaatgggactaatagtgatacttattactgtgaaacttaagacacctttttttttttttttttttttttaaatagagacaaagtctcactacgttgcctaggctggtctctaactcctggactcaagcaatcctcctgtctcggcctcccgaagtgctgggagccagacacgtttttaataacaataaagcaactaatactttactgagagcttactctgtgccactggcttcacatcagtttgtacatatgaagtatttggtatgattcctggcacatgctaaacaatatatatattagctaatattattaatcattactatctaaagaatcatgaataaagttaacaatggtttaatacagatacttgagacagtttcaggggcaagaaaggcatctactaaaggtgctagaaatttggctatcaaagaccttcttgagaatgcaatatcaatcatttttggaaagactgttatttcaccaaacgcttcctgtattaaaaaaaaaaattaactggctttgaagttagctagacttgaataaccatccaaataatccaaagctcctatttgccttgtgtaaatttcttttatctgtctgagcaccagtgacttcatctgaaaatgggaacaatggctatcttgttgagatactgaagaattaagagataatacagtatgaaagcagttatcacagtgcctatgaagattttgttgtttccaaagcgtagagatcaggtctcctaaaacatttaaaaataatctaacaaaataagggtcattaagtagctatgccaagaaaaaagaatacactaaatgattatgacaacttgttagggtaataagttataaaacattaaaataatgcactaagattttttaaagtctatatcatatgaaactgaaatcgccatctaacctaaataaactgaacaatcatcccagtgttccattagctcaaatctgaagaaaatacaaaaaaaagtctctaatcaccaataaatgttaagttacctcagagcaaaagaaagttgtatatacccaggtggccaatatccaattccaacaacacagaaaggcagtctccaaagcctcaaagtcccgagatataggaactaggaaacccaagcaacaacctagctccacaagtctgtagtgcccttctcaagccccattaaaaggcaggaagtgggtatgcagcactctcaagggtatctacctctaaaggaagaagcaaagaggacagtcaaatataaactcatagtcctgaattgtagcaaacaagagaggctcactcaagggaagcaaagctgcatttcctgttctgttcctagtaactgctacactaaagtcttaagacacctttgtcatacgcaaggatgattacaaggaaggcacacattagatttctactcaccaccttgagaaaaggataaccactgatgaaaactgtttgcagcagaaaactaattatactaatgttatctttttaaaattcttatttaaccccttaatgattattttagttcattgaactattcaacctttttcttctagtttacttacttttaaagctaatgctatccagaaatgtcttcctggaatttcttattttgccaagaaacaattctctttctaccccccaatctaatcagagcctagaatatgcaaagagatagcaatccatcatccaggacagaaagaatccacgaacatggttgcaaagtgacaaaaacaaataaagcctaatcataaaactctaaataagnccaggtatggtggctcacccctgtaatcccagcgctttggaaggctgaagtgggaagatggcttgagaacaggagtctgagaccagcctaggcaatatattgagcccagtaccaacaaaaattaaaattctaaaaatttgctgaggttgcagtgagctatgattgtgccactgcactccagcctaggagacagagcaagaccctgtctctaaaaatacaaatcaataaatcaaactctgaataggctaattataaagcatacattagaactacaaacctctaaaagcttaccacaaatgtaagccttgtcctatactaaatctggcttcaaaggatttgcagacagtttaataataagcttccaaatgacttctaattatttacacagaagaacacttacatatttaaacataccccttttaattatgaataatgcataattataaattaactatgaaatgctagtctttanacacaatatttggtcaaatcaataaatgcttgacacccggacttgtgcaaggaagacacaggggtatataatctctacctacaggaattctaaaatatacttagaaaatgtttaagtgttaaacaatgttttaactgtcattcaaagaaacaatagaagagatattttaaggtaacacacaattagctcccaaatgaatgacttagtaaatgccatctaacgtgaagagaaaagcgagagagttggcaaagttgtggttagagaagcattcccaagaaagcagaaagtccatgagctctccaaattcacaaacattaactataaaacagttaagagcttactaatttactcttgattttagagaaatacagcctgagatggacagcagtaattgcaaagttattgctcctctcctaagtcaaagataccggaggatggtcaccaaggatggccacagcacacttcaaatggatggcgctcaaagaggtcttgcatatcttcgagatgcttggggaatcctaatggacatgcgctggcgttggatgatgttggtcttttctgcttcttttgttgtccactggcttgtctttgcagtgctctggtatgttctggctgagatgaatggtgatctggaactagatcatgatgccccacctgaaaaccacactatctgtgtcaagtatatcaccagtttcacagctgcattctccttctccctggagacacaactcacaattggttatggtaccatgttccccagtggtgactgtccaagtgcaatcgccttacttgccatacaaatgctcctaggcctcatgctagaggcttttatcacaggtgcttttgtggcgaagattgcccggccaaaaaatcgagctttttcaattcgctttactgacacagcagtagtagctcacatggatggcaaacctaatcttatcttccaagtggccaacacccgacctagccctctaaccagtgtccgggtctcagctgtactctatcaggaaagagaaaatggcaaactctaccagaccagtgtggatttccaccttgatggcatcagttctgacgaatgtccattcttcatctttccactaacgtactatcactccattacaccatcaagtcctctggctactctgctccagcatgaaaatccttctcactttgaattagttgtattcctttcagcaatgcaggagggcactggagaaatatgccaaaggaggacatcctacctaccgtctgaaatcatgttacatcactgttttgcatctctgttgacccgaggttccaaaggtgaatatcaaatcaagatggagaattttgacaagactgtccctgaatttccaactcctctggtttctaaaagcccaaacaggactgacctggatatccacatcaatggacaaagcattgacaattttcagatctctgaaacaggactgacagaataagacttatccattttttaatgtattaaatacacccagccagttatgcagct

SEQ ID NO: 290271 - DNA, 1275 bp, Homo sapiens
agcggagtccaagaagagaacctacaaactagacttgtagattaaaattatctgatcaaaaaggcagactctgtaaatttccttaagacctaccttggcataaaggctgacccagcaaaagaactgagaaatacagcctgagatggacagcagtaattgcaaagttattgctcctctcctaagtcaaagataccggaggatggtcaccaaggatggccacagcacacttcaaatggatggcgctcaaagaggtcttgcatatcttcgagatgcttggggaatcctaatggacatgcgctggcgttggatgatgttggtcttttctgcttcttttgttgtccactggcttgtctttgcagtgctctggtatgttctggctgagatgaatggtgatctggaactagatcatgatgccccacctgaaaaccacactatctgtgtcaagtatatcaccagtttcacagctgcattctccttctccctggagacacaactcacaattggttatggtaccatgttccccagtggtgactgtccaagtgcaatcgccttacttgccatacaaatgctcctaggcctcatgctagaggcttttatcacaggtgcttttgtggcgaagattgcccggccaaaaaatcgagctttttcaattcgctttactgacacagcagtagtagctcacatggatggcaaacctaatcttatcttccaagtggccaacacccgacctagccctctaaccagtgtccgggtctcagctgtactctatcaggaaagagaaaatggcaaactctaccagaccagtgtggatttccaccttgatggcatcagttctgacgaatgtccattcttcatctttccactaacgtactatcactccattacaccatcaagtcctctggctactctgctccagcatgaaaatccttctcactttgaattagttgtattcctttcagcaatgcaggagggcactggagaaatatgccaaaggaggacatcctacctaccgtctgaaatcatgttacatcactgttttgcatctctgttgacccgaggttccaaaggtgaatatcaaatcaagatggagaattttgacaagactgtccctgaatttccaactcctctggtttctaaaagcccaaacaggactgacctggatatccacatcaatggacaaagcattgacaattttcagatctctgaaacaggactgacagaataagacttatccattttttaatgtattaaatacacccagccagttatgcagct

SEQ ID NO: 290272 - DNA, 3601 bp, Homo sapiens
  misc_feature (1910)..(1910): n is a, c, g, or t
  misc_feature (2382)..(2382): n is a, c, g, or t
cttttagagacagggtctcgctatgttggccagatcggtcttgaattcccgacctcaagcaatcctcccgactcaacgtcccaaagtgctagtgttacaggcatgagtcaccatgcctggttcctcactttcgttatctgtaaaatgggactaatagtgatacttattactgtgaaacttaagacacctttttttttttttttttttttttaaatagagacaaagtctcactacgttgcctaggctggtctctaactcctggactcaagcaatcctcctgtctcggcctcccgaagtgctgggagccagacacgtttttaataacaataaagcaactaatactttactgagagcttactctgtgccactggcttcacatcagtttgtacatatgaagtatttggtatgattcctggcacatgctaaacaatatatatattagctaatattattaatcattactatctaaagaatcatgaataaagttaacaatggtttaatacagatacttgagacagtttcaggggcaagaaaggcatctactaaaggtgctagaaatttggctatcaaagaccttcttgagaatgcaatatcaatcatttttggaaagactgttatttcaccaaacgcttcctgtattaaaaaaaaaaattaactggctttgaagttagctagacttgaataaccatccaaataatccaaagctcctatttgccttgtgtaaatttcttttatctgtctgagcaccagtgacttcatctgaaaatgggaacaatggctatcttgttgagatactgaagaattaagagataatacagtatgaaagcagttatcacagtgcctatgaagattttgttgtttccaaagcgtagagatcaggtctcctaaaacatttaaaaataatctaacaaaataagggtcattaagtagctatgccaagaaaaaagaatacactaaatgattatgacaacttgttagggtaataagttataaaacattaaaataatgcactaagattttttaaagtctatatcatatgaaactgaaatcgccatctaacctaaataaactgaacaatcatcccagtgttccattagctcaaatctgaagaaaatacaaaaaaaagtctctaatcaccaataaatgttaagttacctcagagcaaaagaaagttgtatatacccaggtggccaatatccaattccaacaacacagaaaggcagtctccaaagcctcaaagtcccgagatataggaactaggaaacccaagcaacaacctagctccacaagtctgtagtgcccttctcaagccccattaaaaggcaggaagtgggtatgcagcactctcaagggtatctacctctaaaggaagaagcaaagaggacagtcaaatataaactcatagtcctgaattgtagcaaacaagagaggctcactcaagggaagcaaagctgcatttcctgttctgttcctagtaactgctacactaaagtcttaagacacctttgtcatacgcaaggatgattacaaggaaggcacacattagatttctactcaccaccttgagaaaaggataaccactgatgaaaactgtttgcagcagaaaactaattatactaatgttatctttttaaaattcttatttaaccccttaatgattattttagttcattgaactattcaacctttttcttctagtttacttacttttaaagctaatgctatccagaaatgtcttcctggaatttcttattttgccaagaaacaattctctttctaccccccaatctaatcagagcctagaatatgcaaagagatagcaatccatcatccaggacagaaagaatccacgaacatggttgcaaagtgacaaaaacaaataaagcctaatcataaaactctaaataagnccaggtatggtggctcacccctgtaatcccagcgctttggaaggctgaagtgggaagatggcttgagaacaggagtctgagaccagcctaggcaatatattgagcccagtaccaacaaaaattaaaattctaaaaatttgctgaggttgcagtgagctatgattgtgccactgcactccagcctaggagacagagcaagaccctgtctctaaaaatacaaatcaataaatcaaactctgaataggctaattataaagcatacattagaactacaaacctctaaaagcttaccacaaatgtaagccttgtcctatactaaatctggcttcaaaggatttgcagacagtttaataataagcttccaaatgacttctaattatttacacagaagaacacttacatatttaaacataccccttttaattatgaataatgcataattataaattaactatgaaatgctagtctttanacacaatatttggtcaaatcaataaatgcttgacacccggacttgtgcaaggaagacacaggggtatataatctctacctacaggaattctaaaatatacttagaaaatgtttaagtgttaaacaatgttttaactgtcattcaaagaaacaatagaagagatattttaaggtaacacacaattagctcccaaatgaatgacttagtaaatgccatctaacgtgaagagaaaagcgagagagttggcaaagttgtggttagagaagcattcccaagaaagcagaaagtccatgagctctccaaattcacaaacattaactataaaacagttaagagcttactaatttactcttgattttagagaaatacagcctgagatggacagcagtaattgcaaagttattgctcctctcctaagtcaaagataccggaggatggtcaccaaggatggccacagcacacttcaaatggatggcgctcaaagaggtcttgcatatcttcgagatgcttggggaatcctaatggacatgcgctggcgttggatgatgttggtcttttctgcttcttttgttgtccactggcttgtctttgcagtgctctggtatgttctggctgagatgaatggtgatctggaactagatcatgatgccccacctgaaaaccacactatctgtgtcaagtatatcaccagtttcacagctgcattctccttctccctggagacacaactcacaattggttatggtaccatgttccccagtggtgactgtccaagtgcaatcgccttacttgccatacaaatgctcctaggcctcatgctagaggcttttatcacaggtaattttgtctttgttcttaaaaaaaacaaaaacaaaaacaaaacaaaacaaaactacaggtgtttggaaagggtatagtcagttataagtaatgctgttacagaataatttatctatattgatagcaggtaatgtctaagatagaaaagaaacagtttagagccaaaaaaaataggagaaatgcataaggaacctgtctcaatgccaaaattttacttactgtaactacttaagaaaaaagagatcagtatgatactaaattgcagaaatatcccatatcaaaaaaaaaaaattaacaaaaggtttaaaaggaggttttcactgaagctaatcattttgtcaaatacataaataaatacattcaatacctattttgacag

SEQ ID NO: 290273 - DNA, 3056 bp, Homo sapiens
tttttttttgagatggagtcttcctctgttgcccaggctggagtgcagtgctacaaacttggctcactgcaatctcctgcctcagcctcctgagtagctgggattacaggcatgtgccaccagacccagctaatttttgtatttttagtagagacggggtttcatgatgttggccaggctggtctcaaactcctgacctcaaatgacccgcccgcctcgggctcccaaagtgccgggattacaggcgtgagacaccatgcctggccaaaatatcactcattctattggtcccctccccatcccaaatcattctactctgaacctagtctctacttcaacgtaatctggctgtagccaagttgcatttattttctattacttttttttaagcacaggcaggaatataggaaatgaccaattctttgactttgtaagaaactagaggatgaagttttacatttctctgtaacaaaatcattttgcttatctattctgaaatcatggtttttaaacagaaatgtactttgaaaaatgcttcaggcaaataagactgaccaaattaacaatgagttcaattcctgactcactgaaaggcatggcaccaagaaatgtgtaaatatttgatatacacttgtcattcagaaaaagtattgatatttaaagtcttcattctaaaaaaaaatcaataatttcttatttaggtgcttttgtggcgaagattgcccggccaaaaaatcgagctttttcaattcgctttactgacacagcagtagtagctcacatggatggcaaacctaatcttatcttccaagtggccaacacccgacctagccctctaaccagtgtccgggtctcagctgtactctatcaggaaagagaaaatggcaaactctaccagaccagtgtggatttccaccttgatggcatcagttctgacgaatgtccattcttcatctttccactaacgtactatcactccattacaccatcaagtcctctggctactctgctccagcatgaaaatccttctcactttgaattagttgtattcctttcagcaatgcaggagggcactggagaaatatgccaaaggaggacatcctacctaccgtctgaaatcatgttacatcactgttttgcatctctgttgacccgaggttccaaaggtgaatatcaaatcaagatggagaattttgacaagactgtccctgaatttccaactcctctggtttctaaaagcccaaacaggactgacctggatatccacatcaatggacaaagcattgacaattttcagatctctgaaacaggactgacagaataagacttatccattttttaatgtattaaatacacccagccagttatgcagctactttttctttactgtatctcatgttttcttttttcaatgctaattatagctctctacatcacggtaatcatgcctatgcctacataagaatggctgagctaacaatacacattctggaaacataacactctacattacaaagtttgttacctgctgaaatcaatgtaactcaacttgacagacacttatacagaaatgttgctggtgaatttataagaatgtggtatgatactagtaatgaaggcaaaatggacagtgaagtttaacacaactgaactctaagaaaatcaaccattaatctctcattttcatctgcaaattgaagcaacagtttagtttcaaacctagctccctgggtggaatgacgacttcactatacttagtgaatatcctttaagagctgggatttttttcaagacaacaaagatcattcatttggttctttatactatgaaacttgagtaagtattacctccttaatttttaacaactaagaacaaaaattaacgagaaaaacaacaaagtacagatttatacataaacctaaaagcatttgaacatgacacccgaacacatacatatatgttcacttatttgtggcagaaggtgatcagataagctccagcccaaatggaacctgtggggtggtattttgcattgcaaggagacgcaaaattttattttaaaactgtcctccataataatcaaacggtgattcatctaaatgacttctagcaacctaagtaaaaacattcccctcctatgtatgattcatttgatcatataaaacatcatgatggctctaattcataaatacaaaaatatatttaagtctttatagatataaagctttacttagatataacttgagtgagtagggaaaaaaatctacagtagataaagcaaaagataattaggcaacaaagcattttcaaactcaaattcctgtttccaacttcaaatagttttttctataaacacaaaatcagtgtttattcaccagtaggaggttggactagatgaactctattatttctttctaaatctaatagtctataaaaattatgtttcctctgttttttattttatctatgctaaaatgagccctttcccttatgtccagtttaagatgatcatttgcatgattttcatttcaataaaaaaaagagaaactgtccttaaaacaaaacaaaaaccaaaaaagtcaccctatcaggtttcaaacagatttgtggctgttcttttctgaaatttcccttattcaggtttctgtgggaaaaatgaaagattaaccttccccactggtgatgacctaggcaggaatcatctcttgaaataaatactagctgagtaaaggcaagcaggtgtgaagagcagggctcagcagcaagtcacatttttctactatttgaccaaaaggaaaagaaaataaagaagaactctggagtggtctaagactgataatagcagaagaatatcaagaacacagaaacttaattattgtgaacttttgctgtttgaaaatcttagacattcattcttaagtagaaatcagaccaacagattttcccaacccaagactattgtaacacataaagacagcaagaattcttatttctataataaattaacaagattcacctaacctttgaaaataaagtagtattgaagacttaaaaaa

SEQ ID NO: 290274 - DNA, 2721 bp, Homo sapiens
agcggagtccaagaagagaacctacaaactagacttgtagattaaaattatctgatcaaaaaggcagactctgtaaatttccttaagacctaccttggcataaaggctgacccagcaaaagaactgagaaatacagcctgagatggacagcagtaattgcaaagttattgctcctctcctaagtcaaagataccggaggatggtcaccaaggatggccacagcacacttcaaatggatggcgctcaaagaggtcttgcatatcttcgagatgcttggggaatcctaatggacatgcgctggcgttggatgatgttggtcttttctgcttcttttgttgtccactggcttgtctttgcagtgctctggtgcttttgtggcgaagattgcccggccaaaaaatcgagctttttcaattcgctttactgacacagcagtagtagctcacatggatggcaaacctaatcttatcttccaagtggccaacacccgacctagccctctaaccagtgtccgggtctcagctgtactctatcaggaaagagaaaatggcaaactctaccagaccagtgtggatttccaccttgatggcatcagttctgacgaatgtccattcttcatctttccactaacgtactatcactccattacaccatcaagtcctctggctactctgctccagcatgaaaatccttctcactttgaattagttgtattcctttcagcaatgcaggagggcactggagaaatatgccaaaggaggacatcctacctaccgtctgaaatcatgttacatcactgttttgcatctctgttgacccgaggttccaaaggtgaatatcaaatcaagatggagaattttgacaagactgtccctgaatttccaactcctctggtttctaaaagcccaaacaggactgacctggatatccacatcaatggacaaagcattgacaattttcagatctctgaaacaggactgacagaataagacttatccattttttaatgtattaaatacacccagccagttatgcagctactttttctttactgtatctcatgttttcttttttcaatgctaattatagctctctacatcacggtaatcatgcctatgcctacataagaatggctgagctaacaatacacattctggaaacataacactctacattacaaagtttgttacctgctgaaatcaatgtaactcaacttgacagacacttatacagaaatgttgctggtgaatttataagaatgtggtatgatactagtaatgaaggcaaaatggacagtgaagtttaacacaactgaactctaagaaaatcaaccattaatctctcattttcatctgcaaattgaagcaacagtttagtttcaaacctagctccctgggtggaatgacgacttcactatacttagtgaatatcctttaagagctgggatttttttcaagacaacaaagatcattcatttggttctttatactatgaaacttgagtaagtattacctccttaatttttaacaactaagaacaaaaattaacgagaaaaacaacaaagtacagatttatacataaacctaaaagcatttgaacatgacacccgaacacatacatatatgttcacttatttgtggcagaaggtgatcagataagctccagcccaaatggaacctgtggggtggtattttgcattgcaaggagacgcaaaattttattttaaaactgtcctccataataatcaaacggtgattcatctaaatgacttctagcaacctaagtaaaaacattcccctcctatgtatgattcatttgatcatataaaacatcatgatggctctaattcataaatacaaaaatatatttaagtctttatagatataaagctttacttagatataacttgagtgagtagggaaaaaaatctacagtagataaagcaaaagataattaggcaacaaagcattttcaaactcaaattcctgtttccaacttcaaatagttttttctataaacacaaaatcagtgtttattcaccagtaggaggttggactagatgaactctattatttctttctaaatctaatagtctataaaaattatgtttcctctgttttttattttatctatgctaaaatgagccctttcccttatgtccagtttaagatgatcatttgcatgattttcatttcaataaaaaaaagagaaactgtccttaaaacaaaacaaaaaccaaaaaagtcaccctatcaggtttcaaacagatttgtggctgttcttttctgaaatttcccttattcaggtttctgtgggaaaaatgaaagattaaccttccccactggtgatgacctaggcaggaatcatctcttgaaataaatactagctgagtaaaggcaagcaggtgtgaagagcagggctcagcagcaagtcacatttttctactatttgaccaaaaggaaaagaaaataaagaagaactctggagtggtctaagactgataatagcagaagaatatcaagaacacagaaacttaattattgtgaacttttgctgtttgaaaatcttagacattcattcttaagtagaaatcagaccaacagattttcccaacccaagactattgtaacacataaagacagcaagaattcttatttctataataaattaacaagattcacctaacctttgaaaataaagtagtattgaagacttaaaaaa

SEQ ID NO: 290275 - DNA, 2957 bp, Homo sapiens
agcggagtccaagaagagaacctacaaactagacttgtagattaaaattatctgatcaaaaaggcagactctgtaaatttccttaagacctaccttggcataaaggctgacccagcaaaagaactgagaaatacagcctgagatggacagcagtaattgcaaagttattgctcctctcctaagtcaaagataccggaggatggtcaccaaggatggccacagcacacttcaaatggatggcgctcaaagaggtcttgcatatcttcgagatgcttggggaatcctaatggacatgcgctggcgttggatgatgttggtcttttctgcttcttttgttgtccactggcttgtctttgcagtgctctggtatgttctggctgagatgaatggtgatctggaactagatcatgatgccccacctgaaaaccacactatctgtgtcaagtatatcaccagtttcacagctgcattctccttctccctggagacacaactcacaattggttatggtaccatgttccccagtggtgactgtccaagtgcaatcgccttacttgccatacaaatgctcctaggcctcatgctagaggcttttatcacaggtgcttttgtggcgaagattgcccggccaaaaaatcgagctttttcaattcgctttactgacacagcagtagtagctcacatggatggcaaacctaatcttatcttccaagtggccaacacccgacctagccctctaaccagtgtccgggtctcagctgtactctatcaggaaagagaaaatggcaaactctaccagaccagtgtggatttccaccttgatggcatcagttctgacgaatgtccattcttcatctttccactaacgtactatcactccattacaccatcaagtcctctggctactctgctccagcatgaaaatccttctcactttgaattagttgtattcctttcagcaatgcaggagggcactggagaaatatgccaaaggaggacatcctacctaccgtctgaaatcatgttacatcactgttttgcatctctgttgacccgaggttccaaaggtgaatatcaaatcaagatggagaattttgacaagactgtccctgaatttccaactcctctggtttctaaaagcccaaacaggactgacctggatatccacatcaatggacaaagcattgacaattttcagatctctgaaacaggactgacagaataagacttatccattttttaatgtattaaatacacccagccagttatgcagctactttttctttactgtatctcatgttttcttttttcaatgctaattatagctctctacatcacggtaatcatgcctatgcctacataagaatggctgagctaacaatacacattctggaaacataacactctacattacaaagtttgttacctgctgaaatcaatgtaactcaacttgacagacacttatacagaaatgttgctggtgaatttataagaatgtggtatgatactagtaatgaaggcaaaatggacagtgaagtttaacacaactgaactctaagaaaatcaaccattaatctctcattttcatctgcaaattgaagcaacagtttagtttcaaacctagctccctgggtggaatgacgacttcactatacttagtgaatatcctttaagagctgggatttttttcaagacaacaaagatcattcatttggttctttatactatgaaacttgagtaagtattacctccttaatttttaacaactaagaacaaaaattaacgagaaaaacaacaaagtacagatttatacataaacctaaaagcatttgaacatgacacccgaacacatacatatatgttcacttatttgtggcagaaggtgatcagataagctccagcccaaatggaacctgtggggtggtattttgcattgcaaggagacgcaaaattttattttaaaactgtcctccataataatcaaacggtgattcatctaaatgacttctagcaacctaagtaaaaacattcccctcctatgtatgattcatttgatcatataaaacatcatgatggctctaattcataaatacaaaaatatatttaagtctttatagatataaagctttacttagatataacttgagtgagtagggaaaaaaatctacagtagataaagcaaaagataattaggcaacaaagcattttcaaactcaaattcctgtttccaacttcaaatagttttttctataaacacaaaatcagtgtttattcaccagtaggaggttggactagatgaactctattatttctttctaaatctaatagtctataaaaattatgtttcctctgttttttattttatctatgctaaaatgagccctttcccttatgtccagtttaagatgatcatttgcatgattttcatttcaataaaaaaaagagaaactgtccttaaaacaaaacaaaaaccaaaaaagtcaccctatcaggtttcaaacagatttgtggctgttcttttctgaaatttcccttattcaggtttctgtgggaaaaatgaaagattaaccttccccactggtgatgacctaggcaggaatcatctcttgaaataaatactagctgagtaaaggcaagcaggtgtgaagagcagggctcagcagcaagtcacatttttctactatttgaccaaaaggaaaagaaaataaagaagaactctggagtggtctaagactgataatagcagaagaatatcaagaacacagaaacttaattattgtgaacttttgctgtttgaaaatcttagacattcattcttaagtagaaatcagaccaacagattttcccaacccaagactattgtaacacataaagacagcaagaattcttatttctataataaattaacaagattcacctaacctttgaaaataaagtagtattgaagacttaaaaaa

SEQ ID NO: 290276 - DNA, 5574 bp, Homo sapiens
  misc_feature (1910)..(1910): n is a, c, g, or t
  misc_feature (2382)..(2382): n is a, c, g, or t
cttttagagacagggtctcgctatgttggccagatcggtcttgaattcccgacctcaagcaatcctcccgactcaacgtcccaaagtgctagtgttacaggcatgagtcaccatgcctggttcctcactttcgttatctgtaaaatgggactaatagtgatacttattactgtgaaacttaagacacctttttttttttttttttttttttaaatagagacaaagtctcactacgttgcctaggctggtctctaactcctggactcaagcaatcctcctgtctcggcctcccgaagtgctgggagccagacacgtttttaataacaataaagcaactaatactttactgagagcttactctgtgccactggcttcacatcagtttgtacatatgaagtatttggtatgattcctggcacatgctaaacaatatatatattagctaatattattaatcattactatctaaagaatcatgaataaagttaacaatggtttaatacagatacttgagacagtttcaggggcaagaaaggcatctactaaaggtgctagaaatttggctatcaaagaccttcttgagaatgcaatatcaatcatttttggaaagactgttatttcaccaaacgcttcctgtattaaaaaaaaaaattaactggctttgaagttagctagacttgaataaccatccaaataatccaaagctcctatttgccttgtgtaaatttcttttatctgtctgagcaccagtgacttcatctgaaaatgggaacaatggctatcttgttgagatactgaagaattaagagataatacagtatgaaagcagttatcacagtgcctatgaagattttgttgtttccaaagcgtagagatcaggtctcctaaaacatttaaaaataatctaacaaaataagggtcattaagtagctatgccaagaaaaaagaatacactaaatgattatgacaacttgttagggtaataagttataaaacattaaaataatgcactaagattttttaaagtctatatcatatgaaactgaaatcgccatctaacctaaataaactgaacaatcatcccagtgttccattagctcaaatctgaagaaaatacaaaaaaaagtctctaatcaccaataaatgttaagttacctcagagcaaaagaaagttgtatatacccaggtggccaatatccaattccaacaacacagaaaggcagtctccaaagcctcaaagtcccgagatataggaactaggaaacccaagcaacaacctagctccacaagtctgtagtgcccttctcaagccccattaaaaggcaggaagtgggtatgcagcactctcaagggtatctacctctaaaggaagaagcaaagaggacagtcaaatataaactcatagtcctgaattgtagcaaacaagagaggctcactcaagggaagcaaagctgcatttcctgttctgttcctagtaactgctacactaaagtcttaagacacctttgtcatacgcaaggatgattacaaggaaggcacacattagatttctactcaccaccttgagaaaaggataaccactgatgaaaactgtttgcagcagaaaactaattatactaatgttatctttttaaaattcttatttaaccccttaatgattattttagttcattgaactattcaacctttttcttctagtttacttacttttaaagctaatgctatccagaaatgtcttcctggaatttcttattttgccaagaaacaattctctttctaccccccaatctaatcagagcctagaatatgcaaagagatagcaatccatcatccaggacagaaagaatccacgaacatggttgcaaagtgacaaaaacaaataaagcctaatcataaaactctaaataagnccaggtatggtggctcacccctgtaatcccagcgctttggaaggctgaagtgggaagatggcttgagaacaggagtctgagaccagcctaggcaatatattgagcccagtaccaacaaaaattaaaattctaaaaatttgctgaggttgcagtgagctatgattgtgccactgcactccagcctaggagacagagcaagaccctgtctctaaaaatacaaatcaataaatcaaactctgaataggctaattataaagcatacattagaactacaaacctctaaaagcttaccacaaatgtaagccttgtcctatactaaatctggcttcaaaggatttgcagacagtttaataataagcttccaaatgacttctaattatttacacagaagaacacttacatatttaaacataccccttttaattatgaataatgcataattataaattaactatgaaatgctagtctttanacacaatatttggtcaaatcaataaatgcttgacacccggacttgtgcaaggaagacacaggggtatataatctctacctacaggaattctaaaatatacttagaaaatgtttaagtgttaaacaatgttttaactgtcattcaaagaaacaatagaagagatattttaaggtaacacacaattagctcccaaatgaatgacttagtaaatgccatctaacgtgaagagaaaagcgagagagttggcaaagttgtggttagagaagcattcccaagaaagcagaaagtccatgagctctccaaattcacaaacattaactataaaacagttaagagcttactaatttactcttgattttagagaaatacagcctgagatggacagcagtaattgcaaagttattgctcctctcctaagtcaaagataccggaggatggtcaccaaggatggccacagcacacttcaaatggatggcgctcaaagaggtcttgcatatcttcgagatgcttggggaatcctaatggacatgcgctggcgttggatgatgttggtcttttctgcttcttttgttgtccactggcttgtctttgcagtgctctggtatgttctggctgagatgaatggtgatctggaactagatcatgatgccccacctgaaaaccacactatctgtgtcaagtatatcaccagtttcacagctgcattctccttctccctggagacacaactcacaattggttatggtaccatgttccccagtggtgactgtccaagtgcaatcgccttacttgccatacaaatgctcctaggcctcatgctagaggcttttatcacaggtgcttttgtggcgaagattgcccggccaaaaaatcgagctttttcaattcgctttactgacacagcagtagtagctcacatggatggcaaacctaatcttatcttccaagtggccaacacccgacctagccctctaaccagtgtccgggtctcagctgtactctatcaggaaagagaaaatggcaaactctaccagaccagtgtggatttccaccttgatggcatcagttctgacgaatgtccattcttcatctttccactaacgtactatcactccattacaccatcaagtcctctggctactctgctccagcatgaaaatccttctcactttgaattagttgtattcctttcagcaatgcaggagggcactggagaaatatgccaaaggaggacatcctacctaccgtctgaaatcatgttacatcactgttttgcatctctgttgacccgaggttccaaaggtgaatatcaaatcaagatggagaattttgacaagactgtccctgaatttccaactcctctggtttctaaaagcccaaacaggactgacctggatatccacatcaatggacaaagcattgacaattttcagatctctgaaacaggactgacagaataagacttatccattttttaatgtattaaatacacccagccagttatgcagctactttttctttactgtatctcatgttttcttttttcaatgctaattatagctctctacatcacggtaatcatgcctatgcctacataagaatggctgagctaacaatacacattctggaaacataacactctacattacaaagtttgttacctgctgaaatcaatgtaactcaacttgacagacacttatacagaaatgttgctggtgaatttataagaatgtggtatgatactagtaatgaaggcaaaatggacagtgaagtttaacacaactgaactctaagaaaatcaaccattaatctctcattttcatctgcaaattgaagcaacagtttagtttcaaacctagctccctgggtggaatgacgacttcactatacttagtgaatatcctttaagagctgggatttttttcaagacaacaaagatcattcatttggttctttatactatgaaacttgagtaagtattacctccttaatttttaacaactaagaacaaaaattaacgagaaaaacaacaaagtacagatttatacataaacctaaaagcatttgaacatgacacccgaacacatacatatatgttcacttatttgtggcagaaggtgatcagataagctccagcccaaatggaacctgtggggtggtattttgcattgcaaggagacgcaaaattttattttaaaactgtcctccataataatcaaacggtgattcatctaaatgacttctagcaacctaagtaaaaacattcccctcctatgtatgattcatttgatcatataaaacatcatgatggctctaattcataaatacaaaaatatatttaagtctttatagatataaagctttacttagatataacttgagtgagtagggaaaaaaatctacagtagataaagcaaaagataattaggcaacaaagcattttcaaactcaaattcctgtttccaacttcaaatagttttttctataaacacaaaatcagtgtttattcaccagtaggaggttggactagatgaactctattatttctttctaaatctaatagtctataaaaattatgtttcctctgttttttattttatctatgctaaaatgagccctttcccttatgtccagtttaagatgatcatttgcatgattttcatttcaataaaaaaaagagaaactgtccttaaaacaaaacaaaaaccaaaaaagtcaccctatcaggtttcaaacagatttgtggctgttcttttctgaaatttcccttattcaggtttctgtgggaaaaatgaaagattaaccttccccactggtgatgacctaggcaggaatcatctcttgaaataaatactagctgagtaaaggcaagcaggtgtgaagagcagggctcagcagcaagtcacatttttctactatttgaccaaaaggaaaagaaaataaagaagaactctggagtggtctaagactgataatagcagaagaatatcaagaacacagaaacttaattattgtgaacttttgctgtttgaaaatcttagacattcattcttaagtagaaatcagaccaacagattttcccaacccaagactattgtaacacataaagacagcaagaattcttatttctataataaattaacaagattcacctaacctttgaaaataaagtagtattgaagacttaaaaaa

SEQ ID NO: 290277 - DNA, 3594 bp, Homo sapiens
tgtcgagaggggacgctccctcctcgtaggcgtccacactggagaaggaataagatgggcgattgcctgggaagcctgacagggcggcggcagctgggatgctggagaggactggccccttgagttactgagtccgatgaatgtgcttgctctgctggaggaaccgcgctcaggttacagtcatcccaatatggttctgaagacatccaagtggagatatggcatttaaattcatgagattggatgagatcccaccaaaggaacaggtttaggtggagacaaccaaataccgatgcctaggacactgcagtgtttagaattcaaggagatgagaaggaaacaggagggaagattgaaaagaagagtccagtgtgttatgaggaaaaccccaagagcatgctgccttacaagacaggtgaaaaatgtgttctgtgaaagaaagagtaattaactgttaaatgttacagactgatcaaataaaatgaagactgagaatggcctgtttgtaagagggagacatcaacctgttgtggaaaagaatgatcacttaaagtctttagaaattctgaaccaactctctagcaggtgatccttgttagaatttgagcccttaacgctatccaggactggaggttgaagggacgatagagggagcaggaggagaatgcacatggattaaggagcgagaacacagaaatcctgggctctcttctcccagccacaaggttaggttgaaaaacagagcagatggaggtagtttgtagcctacaggtgccctgaatgaagcttccacagtgctaaagtggaagaacgagggactccaagggaaggattcaaggctgggcccatgcactgtgtaattcagaagagaccccagaggagatcagcgccctctaattagccctgtatctgggctctacaggacagacatgcctccatttatgcaacaaataagaacagcatctcatgacagtggagaaaacatgggatgtgcaggtagggttttgttttgcctcttggtagtttctttcctacggaaaattctccctctgatctttccaagtcaaaggcttcagcaaacatttgttgaacgcgtggattgtgctaggtgggtgttatggaccatggagaatgctagagatgtaagacatgcgctgtccaatcgcagcgcaggttgtgttgacagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagggcagaaaaggcctctcaaacactcacctcatttggaatgaagatggagactcttttgcctgaagcaacgatggagcagtgaccctctaatcaactcggtggcctaaagaaaaatcttgggtaacattttcacttcaatttccctctgggatcattgtaatccatgaaaaaaataattttaaagaaagagttaaaatactttgaagttagttatgtggttaaaaaccaccttcctttctattatcaatccaacaatttgataactgtaaacgctaaagtgaagacggattctcttcagatggtctccttaactgcccagggcttgcagatgtctcacccatgaggggcaccaatgtagaaagctgaggcttcatctactgatgagcttcactggtttcccctgaggtttgtgctttggcagagaaggggaggaggggactgggattgtgtggtcagctgtgcctgccaacagatgcaggttaggaactgtgttcagtatcttccaataagaaaggggaaatgccgatgcctatcctctttgtttaggtagaaagtaaaatgctactggacttaaatgggcaacaaggggctttgcctgttcatttgccatggagagggctgggaatccaggtgcggtggctcacacctgtaatcccaacactttgggaggccgaggtgggcagatcagttgaggtcaggagtttgaaaccagcctggccaacatggcgaaaccccgtctctattaaaaatataataattagccaggcatggtggtgtgtgcttgtaatcccagctactcaggaggctgaggcatgagaatggcttgaacctggaaggcaaaggttgcagtgagccgagattgggccaccgcactccagcctgggtgactgacagagtgagacttgtcaaaaa

SEQ ID NO: 290278 - DNA, 2786 bp, Homo sapiens
ctcggtctttaaaaggaagaaggggcttatcgttaagtcgcttgtgatcttttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagggcagaaaaggcctctcaaacactcacctcatttggaatgaagatggagactcttttgcctgaagcaacgatggagcagtgaccctctaatcaactcggtggcctaaagaaaaatcttgggtaacattttcacttcaatttccctctgggatcattgtaatccatgaaaaaaataattttaaagaaagagttaaaatactttgaagttagttatgtggttaaaaaccaccttcctttctattatcaatccaacaatttgataactgtaaacgctaaagtgaagacggattctcttcagatggtctccttaactgcccagggcttgcagatgtctcacccatgaggggcaccaatgtagaaagctgaggcttcatctactgatgagcttcactggtttcccctgaggtttgtgctttggcagagaaggggaggaggggactgggattgtgtggtcagctgtgcctgccaacagatgcaggttaggaactgtgttcagtatcttccaataagaaaggggaaatgccgatgcctatcctctttgtttaggtagaaagtaaaatgctactggacttaaatgggcaacaaggggctttgcctgttcatttgccatggagagggctgggaatccaggtgcggtggctcacacctgtaatcccaacactttgggaggccgaggtgggcagatcagttgaggtcaggagtttgaaaccagcctggccaacatggcgaaaccccgtctctattaaaaatataataattagccaggcatggtggtgtgtgcttgtaatcccagctactcaggaggctgaggcatgagaatggcttgaacctggaaggcaaaggttgcagtgagccgagattgggccaccgcactccagcctgggtgactgacagagtgagacttgtcaaaaa

SEQ ID NO: 290279 - DNA, 2098 bp, Homo sapiens
tgtcgagaggggacgctccctcctcgtaggcgtccacactggagaaggaataagatgggcgattgcctgggaagcctgacagggcggcggcagctgggatgctggagaggactggccccttgagttactgagtccgatgaatgtgcttgctctgctggaggaaccgcgctcaggttacagtcatcccaatatggttctgaagacatccaagtggagatatggcatttaaattcatgagattggatgagatcccaccaaaggaacaggtttaggtggagacaaccaaataccgatgcctaggacactgcagtgtttagaattcaaggagatgagaaggaaacaggagggaagattgaaaagaagagtccagtgtgttatgaggaaaaccccaagagcatgctgccttacaagacaggtgaaaaatgtgttctgtgaaagaaagagtaattaactgttaaatgttacagactgatcaaataaaatgaagactgagaatggcctgtttgtaagatcacttttaaaaggaaaacataggagcctgaaacagaagtgggaaacaaatatttactcaaactaagagactaaactcagtagccagcaacaagagatcaagatggagtcctcctctgtcacccaggctggaacgcagtggtatgatctcggctaactgcaacctcagcctgccaggttcaagcaattcttctgcctcagcctcccgagtagctgggattacaggtgcctgctgccatgatgattaattttatgtgttaacttagctgggctgtgttgcccagatagttggttaaacattattctggatgtttctgtgaagatgtttttggatgaggttaacatttagatcggtggactttgagtaaagcagattacctttcataatttgggtggggctcatccaatcagttgaacatctgaagagaccaaaagactgaccttctgcaagcaaagaaaaattctgccaacagacagccattggacttgaacttcaacattgactcttcagtctattggcccaccctgcaaattttggacttgccagtaagtgtctgaaatctagtgaggcaatttctttcttttttttttttttgagatggagtttcgctcttgttgtccaggctggagtgcagtggtgcgatctcagctcaccgtaacctctgcctcccaggttcaagtgattcttctgcctcagcctcctgagtagctgggattacaggcatgtgccaccacgcctggctacttttgtatttttagtagagatggggtttctccatattggtcaggctggtctcaaattcccaaactcaggtgatccacccgccttggcctcccaaagtgctgggattacaggtgtgagccacagtgcccagcctaatttctttctttctttctttctttttttgagacagagttttgctctttttgaccagaaaggagtgcaatgtggcaggatgttggctcactgcaacctccacctcctggcctctctagtagctgggattacaggcgcctgccaccacgcccagctaatttttgtatttttagtagagatggggtttcaccatgttggccaggctggtctcaaactcctgaaattacgtgatctgcccgccttggcctcccaaagtgctgggattacaggcgtgagccaccatgcctagccgggtagtttatcttgacttgacttcaggctcaccaatccttttggctgcaattctacgatagaaaaggacataaaaaactttaaattagccttagaataaagagatgttatcattccctagcaattagtattcaaagcaagatccaaatatgtaattagtcatttatgtatctaagctgtttgtatgtatgatacaagttttcacatacaaatttcttctttctttctttctttttttttgatagaggcagggtttcacgacattgcccaggctggtcttgagctcaagtgatccatctgccttggcctcccaaagtgctgagattacaggcatgagccacagtgcctggcccaaattattgtagttatttccaattcctttcccccttctcacatcccaattaaagaattccactcagg

SEQ ID NO: 290280 - DNA, 2471 bp, Homo sapiens
tgtcgagaggggacgctccctcctcgtaggcgtccacactggagaaggaataagatgggcgattgcctgggaagcctgacagggcggcggcagctgggatgctggagaggactggccccttgagttactgagtccgatgaatgtgcttgctctgctggaggaaccgcgctcaggttacagtcatcccaatatggttctgaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccgggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagggcagaaaaggcctctcaaacactcacctcatttggaatgaagatggagactcttttgcctgaagcaacgatggagcagtgaccctctaatcaactcggtggcctaaagaaaaatcttgggtaacattttcacttcaatttccctctgggatcattgtaatccatgaaaaaaataattttaaagaaagagttaaaatactttgaagttagttatgtggttaaaaaccaccttcctttctattatcaatccaacaatttgataactgtaaacgctaaagtgaagacggattctcttcagatggtctccttaactgcccagggcttgcagatgtctcacccatgaggggcaccaatgtagaaagctgaggcttcatctactgatgagcttcactggtttcccctgaggtttgtgctttggcagagaaggggaggaggggactgggattgtgtggtcagctgtgcctgccaacagatgcaggttaggaactgtgttcagtatcttccaataagaaaggggaaatgccgatgcctatcctctttgtttaggtagaaagtaaaatgctactggacttaaatgggcaacaaggggctttgcctgttcatttgccatggagagggctgggaatccaggtgcggtggctcacacctgtaatcccaacactttgggaggccgaggtgggcagatcagttgaggtcaggagtttgaaaccagcctggccaacatggcgaaaccccgtctctattaaaaatataataattagccaggcatggtggtgtgtgcttgtaatcccagctactcaggaggctgaggcatgagaatggcttgaacctggaaggcaaaggttgcagtgagccgagattgggccaccgcactccagcctgggtgactgacagagtgagacttgtcaaaaa

SEQ ID NO: 290281 - DNA, 1429 bp, Homo sapiens
ccttcccttccgattgcatttttctcttttcttttgctgggtgttctttcttcttcatcttttttctgttctgctttttccttttttttttttcataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagtaacaagggcatggaacatctgctcaacatgaagtgcaaaaatgtggtcccagtgtatgacctgctgctggagatgctgaatgcccacgtgcttcgcgggtgcaagtcctccatcacggggtccgagtgcagcccggcagaggacagtaaaagcaaagagggctcccagaacccacagtctcagtgacgcctggccctgaggtgaactggcccacagaggtcacaagctgaagcgtgaactccagtgtgtcaggagcctgggcttcatctttctgctgtgtggtccctcatttgg

SEQ ID NO: 290282 - DNA, 2266 bp, Homo sapiens
ccttcccttccgattgcatttttctcttttcttttgctgggtgttctttcttcttcatcttttttctgttctgctttttccttttttttttttcataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacaggtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgaggtacgcgccctaaggagctgctctgcttgggcttgggatgggattatgtgctccacggagggtgaagtgatttgggaaaagtgtctgcaagttaaggaaaatgaatgcctcatttggaatgaagatggagactcttttgcctgaagcaacgatggagcagtgaccctctaatcaactcggtggcctaaagaaaaatcttgggtaacattttcacttcaatttccctctgggatcattgtaatccatgaaaaaaataattttaaagaaagagttaaaatactttgaagttagttatgtggttaaaaaccaccttcctttctattatcaatccaacaatttgataactgtaaacgctaaagtgaagacggattctcttcagatggtctccttaactgcccagggcttgcagatgtctcacccatgaggggcaccaatgtagaaagctgaggcttcatctactgatgagcttcactggtttcccctgaggtttgtgctttggcagagaaggggaggaggggactgggattgtgtggtcagctgtgcctgccaacagatgcaggttaggaactgtgttcagtatcttccaataagaaaggggaaatgccgatgcctatcctctttgtttaggtagaaagtaaaatgctactggacttaaatgggcaacaaggggctttgcctgttcatttgccatggagagggctgggaatccaggtgcggtggctcacacctgtaatcccaacactttgggaggccgaggtgggcagatcagttgaggtcaggagtttgaaaccagcctggccaacatggcgaaaccccgtctctattaaaaatataataattagccaggcatggtggtgtgtgcttgtaatcccagctactcaggaggctgaggcatgagaatggcttgaacctggaaggcaaaggttgcagtgagccgagattgggccaccgcactccagcctgggtgactgacagagtgagacttgtcaaaaa

SEQ ID NO: 290283 - DNA, 1456 bp, Homo sapiens
tgtcgagaggggacgctccctcctcgtaggcgtccacactggagaaggaataagatgggcgattgcctgggaagcctgacagggcggcggcagctgggatgctggagaggactggccccttgagttactgagtccgatgaatgtgcttgctctgctggaggaaccgcgctcaggttacagtcatcccaatatggttctgaagacatccaagtggagatatggcatttaaattcatgagattggatgagatcccaccaaaggaacaggtttaggtggagacaaccaaataccgatgcctaggacactgcagtgtttagaattcaaggagatgagaaggaaacaggagggaagattgaaaagaagagtccagtgtgttatgaggaaaaccccaagagcatgctgccttacaagacagtggtccatcgccagttatcacatctgtatgcggaacctcaaaagagtccctggtgtgaagcaagatcgctagaacacaccttacctgtaaacagctcctgatgctcctgtcccacgtcaggcatgcgagggcagaaaaggcctctcaaacactcacctcatttggaatgaagatggagactcttttgcctgaagcaacgatggagcagtgaccctctaatcaactcggtggcctaaagaaaaatcttgggtaacattttcacttcaatttccctctgggatcattgtaatccatgaaaaaaataattttaaagaaagagttaaaatactttgaagttagttatgtggttaaaaaccaccttcctttctattatcaatccaacaatttgataactgtaaacgctaaagtgaagacggattctcttcagatggtctccttaactgcccagggcttgcagatgtctcacccatgaggggcaccaatgtagaaagctgaggcttcatctactgatgagcttcactggtttcccctgaggtttgtgctttggcagagaaggggaggaggggactgggattgtgtggtcagctgtgcctgccaacagatgcaggttaggaactgtgttcagtatcttccaataagaaaggggaaatgccgatgcctatcctctttgtttaggtagaaagtaaaatgctactggacttaaatgggcaacaaggggctttgcctgttcatttgccatggagagggctgggaatccaggtgcggtggctcacacctgtaatcccaacactttgggaggccgaggtgggcagatcagttgaggtcaggagtttgaaaccagcctggccaacatggcgaaaccccgtctctattaaaaatataataattagccaggcatggtggtgtgtgcttgtaatcccagctactcaggaggctgaggcatgagaatggcttgaacctggaaggcaaaggttgcagtgagccgagattgggccaccgcactccagcctgggtgactgacagagtgagacttgtcaaaaa

SEQ ID NO: 290284 - DNA, 380 bp, Homo sapiens
gatttgggaaaagtgtctgcaagttaaggaaaatgaatgcctgaaagggaatggggaatttgtcagttcacacacctgtaagcaaagatgggcacagagtgggcatggaaggaatgtcatgtggtatcttacaggctctgcatggcagccagtggtggctcatgggtttttcaattgctggggtttatagcctgtttatggagtcctaaaaggggcagttcctcccctaacacgaactgccacccctgtttacaccacccagggctgaggccctgaggccactttttgtggagaggctaagacccgctcccctagatggcccctcgagctggtgatgcgaagaagtgcacaaatgcttccctaagagttgttctttcggt

SEQ ID NO: 290285 - DNA, 510 bp, Homo sapiens
tgcttatttttccataagaactttcatttttatttaatcctgtgttttttggttttaaagactattttataataaattttcgtgattaaactcttgtgcttaaactcttgattaaacaaacaagcaatgaagagatgaatgaagcagaaaatgtgagtttcatgcctcacattcccactcctctgaggttaatattttcatgtatatttttcaggatgtatttgtaatctcatacaaacgtatgtatttttttaatgaaaatatttaaattttcatagttaacagctgtagctctaacttggcaatatcttctgtgtttctttacagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatac

SEQ ID NO: 290286 - DNA, 2169 bp, Homo sapiens
ctcggtctttaaaaggaagaaggggcttatcgttaagtcgcttgtgatcttttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagtaacaagggcatggaacatctgctcaacatgaagtgcaaaaatgtggtcccagtgtatgacctgctgctggagatgctgaatgcccacgtgcttcgcgggtgcaagtcctccatcacggggtccgagtgcagcccggcagaggacagtaaaagcaaagagggctcccagaacccacagtctcagtgacgcctggccctgaggtgaactggcccacagaggtcacaagctgaagcgtgaactccagtgtgtcaggagcctgggcttcatctttctgctgtgtggtccctcatttgg

SEQ ID NO: 290287 - DNA, 2695 bp, Homo sapiens
  misc_feature (1957)..(1957): n is a, c, g, or t
  misc_feature (2090)..(2090): n is a, c, g, or t
ctcggtctttaaaaggaagaaggggcttatcgttaagtcgcttgtgatcttttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagctctctctcactctcttggagattgtttatgctgagggaagccagctgccatggtgtgaggcagactcctggaggagcccacntgtctgtaagtagaagcagatcttttgaggcctgtcaacagccacgggaatgagcttggaagcagatcccacctcctccctcacacaagtcgagccttcagatgagcctgcagcctttgtcgacaccttgacngcattctcatgagagaccttgagccagagatacttagctaagccatgcccatggactcctgacccacagaaactgtgataataagtttgttgtttcaagctgctaacttatggagtaatatgttacacaaaaatagctaatatatagctcaaaactggaagcaacccaaatatctattaactggtagataaacaaactactcatttccaaacttatttccaaaactggaacactacttggcaatcaaataattaactatgcattaagtgtaacaacctggatgaatctcaaaggcattatgttaagtgaaacaagtgagccacgtaagactacatactgtttgattccctctatatgatattctagaaaaggcaaaactatagtaataggaaacagtgagtgatcacctagggttgaagacaggtgaaaggggattgactgcaaagaggcaggaggaaacgtcttgggagatggagatgttccttatattgatggcggtggtggttacacaactgcacttttatcaaaacttacctaactgctacttaaaataggtgtattaatatttttactgtatgtaaattatacctcaataaatttgattt

SEQ ID NO: 290288 - DNA, 1702 bp, Homo sapiens
ccttcccttccgattgcatttttctcttttcttttgctgggtgttctttcttcttcatcttttttctgttctgctttttccttttttttttttcataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagtaacaagggcatggaacatctgctcaacatgaagtgcaaaaatgtggtcccagtgtatgacctgctgctggagatgctgaatgcccacgtgcttcgcgggtgcaagtcctccatcacggggtccgagtgcagcccggcagaggacagtaaaagcaaagagggctcccagaacccacagtctcagtgacgcctggccctgaggtgaactggcccacagaggtcacaagctgaagcgtgaactccagtgtgtcaggagcctgggcttcatctttctgctgtgtggtccctcatttgg

SEQ ID NO: 290289 - DNA, 2500 bp, Homo sapiens
ccttcccttccgattgcatttttctcttttcttttgctgggtgttctttcttcttcatcttttttctgttctgctttttccttttttttttttcataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacaggtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagatggggagaaaagcaattcattcatttgaagttatcttagtgccaagagtcatgtgaaaatgtcccttgcatgtgggcaatgaaagatttgcagacgatataaaacccagactacctcataaaagagttttgggaatacactgagctttgagtgaaagaagctgcagtggcctccctggagatggggagcaaaccagcttaaaggcccttatcctgaggaagagacaaaaattgacatgcacaatattaagctttgaaatgcagaccacacttcctttcactgcaactttgacttgtcccgcatctctacttaagggcagaaaaggcctctcaaacactcacctcatttggaatgaagatggagactcttttgcctgaagcaacgatggagcagtgaccctctaatcaactcggtggcctaaagaaaaatcttgggtaacattttcacttcaatttccctctgggatcattgtaatccatgaaaaaaataattttaaagaaagagttaaaatactttgaagttagttatgtggttaaaaaccaccttcctttctattatcaatccaacaatttgataactgtaaacgctaaagtgaagacggattctcttcagatggtctccttaactgcccagggcttgcagatgtctcacccatgaggggcaccaatgtagaaagctgaggcttcatctactgatgagcttcactggtttcccctgaggtttgtgctttggcagagaaggggaggaggggactgggattgtgtggtcagctgtgcctgccaacagatgcaggttaggaactgtgttcagtatcttccaataagaaaggggaaatgccgatgcctatcctctttgtttaggtagaaagtaaaatgctactggacttaaatgggcaacaaggggctttgcctgttcatttgccatggagagggctgggaatccaggtgcggtggctcacacctgtaatcccaacactttgggaggccgaggtgggcagatcagttgaggtcaggagtttgaaaccagcctggccaacatggcgaaaccccgtctctattaaaaatataataattagccaggcatggtggtgtgtgcttgtaatcccagctactcaggaggctgaggcatgagaatggcttgaacctggaaggcaaaggttgcagtgagccgagattgggccaccgcactccagcctgggtgactgacagagtgagacttgtcaaaaa

SEQ ID NO: 290290 - DNA, 285 bp, Homo sapiens
gcggcccctactactactaaattcgcggcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaa

SEQ ID NO: 290291 - DNA, 221 bp, Homo sapiens
agggcctaagccttaggggctgcttgggggaagtgtcagttaagctcatggggtgagtctagagtttgactcacaaaaggggcttgataactgtctgaatggcttttctccaggacaggggaaagtatcttgtcgctgctgagggatccctccaaaaggaaggttccaccccagccccttacacccaaccatatccttataaatatgtgaggaaaggtaag

SEQ ID NO: 290292 - DNA, 1551 bp, Homo sapiens
ggtggtgggcccacacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaactctgtgcaacctacatggaggtgggggcagccgatgcctggtccaggctgtgagggacacgtatggagcagataaagaattcactcaagcagaaaaaaaaaaaaaaaa

SEQ ID NO: 290293 - DNA, 1548 bp, Homo sapiens
tcgaaccttaggctaggtagcgaggcctgggtgttgggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaactctgtgcaacctacatggaggtgggggcagccgatgcctggtccaggctgtgagggacacgtatggagcagataaagaattcactcaagcagaaaaaaaaaaaaaaaa

SEQ ID NO: 290294 - DNA, 1794 bp, Homo sapiens
ggtggtgggcccacacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaactctgtgcaacctacatggaggtgggggcagccgatgcctggtccaggctgtgagggacacgtatggagcagataaagaattcactcaagcagaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaacaaccgggacgcacaatgagagcaagaccaatcgccgcgagagcgacacacaacacaaagacgaaaaccaccgggtgcgtgctagacgaacagcagggccgctccacagagacgaccctgtcatacactagaccgaccgagagcgcgcgaggaaaagaaacacgaga

SEQ ID NO: 290295 - DNA, 1818 bp, Homo sapiens
  misc_feature (1564)..(1564): n is a, c, g, or t
  misc_feature (1571)..(1571): n is a, c, g, or t
ggtggtgggcccacacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaaataaaccttgctaagtccaaaaaaaaaaaaaaaaaaaaaaacacccgcgctctatctgcgcgcgggcggcgcaccacagcgttcagaaacggcaacaggttcaaagctcttcccgacccccntttttgnccaaggggaatgccggaccctaaaggagcggctaaaattgcaaacccggtcgtaattgtcgccgatcaaaaacagcgaacaacatccacagcggcgtgatcacacttcataacaactgacgcagacaaaccacacccagcaacatgacaacacgataaacaacaacgatacaaacatataactacgtctagcaggacgacacaacaacaccacactaatctgaccccaatacaaaaacactaggcca

SEQ ID NO: 290296 - DNA, 1549 bp, Homo sapiens
ggtggtgggcccacacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtcacctttcctcagactgagtctacctcagacgggtggttgactctgcctcaataacttgtagtcaaaaaaaagggggcgaaaataccgggggccatacgcctttgcaagggccagagtaaaacgggcggtaaaggaggaagcggctggggccttggggaaggccccacacggaaaatggagccggggctaacaag

SEQ ID NO: 290297 - DNA, 1572 bp, Homo sapiens
tcttcgaagaatcctccggctgggaaaactatcgtccagaccctgaatcctccggctgtactgccaagtcatttcctagggccgcactcaaggtgtcagactcacgtgggctcatcactgcgtcctctcatattttcaatatgaatgacttttatcaggaaatctgaaaattagtgaaaggttcatttttctcagcatccggaaggctcgaagggcaggcaggaggggcgcgaacaggggctttgccctcctggagagacagcatgaacacagatgttcccagcgcaggcgaaggagaatgctggcttcagcggttgtgggggagacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaaaaaaaaaaatggggtttttcgggcgggaaaagata

SEQ ID NO: 290298 - DNA, 1517 bp, Homo sapiens
caaacttaggctaggtagcgaggctgggtgttatcaggtgtcagactcacgtgggctcatcactgcgtcctctcatattttcaatatgaatgacttttatcaggaaatctgaaaattagtgaaaggttcatttttctcagcatccggaaggctcgaagggcaggcaggaggggcgcgaacaggggctttgccctcctggagagacagcatgaacacagatgttcccagcgcaggcgaaggagaatgctggcttcagcggttgtgggggagacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaaaaaaaaaaatggggtttttcgggcgggaaaagata

SEQ ID NO: 290299 - DNA, 1375 bp, Homo sapiens
tcgaaccttaggctaggtagcgaggcctgggtgttgggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcattgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaaaaaaaaaaatggggtttttcgggcgggaaaagata

SEQ ID NO: 290300 - DNA, 1915 bp, Homo sapiens
tcgaaccttaggctaggtagcgaggcctgggtgttgggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcaggtcaacacctcttcctttctggtcccctctcgttttctgcatttccatctcttcccaatttcctgcagcagagggagtaaaggagtagccaagacagcatgggtcactcagggctccacaaagcgagtccaggatctatagaaagtttctgccctgccatcccccaacatacacacatgccctctttccatcctgtcttcctcccagacagcattccttgttggaattagtccttcacattctaaatactcagtatatgctcattcgcatctagtaggcatagagactatgtatctgcctcctgcctactccaggctcttccctccaacagttgtgagtgtaggtcccatcttggagtttgttggcgtggcggcgggggggaggttgctgtggtgatggtggggggtatgtctttgggtgttgtgtgcatggccctggagctgatctccacccttcctctcccctgctcaccccagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaa

SEQ ID NO: 290301 - DNA, 831 bp, Homo sapiens
tgactgagcaagctggcaggctgagcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaa

SEQ ID NO: 290302 - DNA, 1195 bp, Homo sapiens
tcgaaccttaggctaggtagcgaggcctgggtgttgggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggagacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggcctcaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaa

SEQ ID NO: 290303 - DNA, 890 bp, Homo sapiens
tcgaaccttaggctaggtagcgaggcctgggtgttgggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaa

SEQ ID NO: 290304 - DNA, 897 bp, Homo sapiens
aggggaccccaatcatagaagtcctattctgcaccactgtgctgagcacttcacatattgaaggatatttgattcttaattctaaatacgagctactcttatgagtacttctccctggtactatcataagagatttacatatgttctaatattgaaagctcacaagagaccccgagacagggaggtacacttacatttactattctcattttacagatggaaaaattaagacttcatgaggttaagtaacttaccaaggtcacacagccagtaagttaggggttcaaacccacaagaccttatggccctaggtattactctctccatattccatatttggttgaggagcaggtccagagaggttaataaacttgcccaaaggcatgcatcaaggaatggcagagccagagggctatgtgacctaaaaactattgcccctctgttttgggatagtcccccccacacacactcctgcccttggccttgaccaccgcatacagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaa

SEQ ID NO: 290305 - DNA, 199 bp, Homo sapiens
ggcagacaagttctagactcagaagtaaccagatcatcttgtcttcttccagacacagagattgactggaaggcctacatggccgaggtagaaggcgtcatcaatggtacctatgactatacccaactgcagggtgacaccggaccacttgtgtgagtggggacaggaagttcagggaggatgtgaggggctggttagg

SEQ ID NO: 290306 - DNA, 1442 bp, Homo sapiens
ggtggtgggcccacacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaa

SEQ ID NO: 290307 - DNA, 1477 bp, Homo sapiens
ggtggtgggcccacacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaaaaaaaaaaatggggtttttcgggcgggaaaagata

SEQ ID NO: 290308 - DNA, 2551 bp, Homo sapiens
ggtggtgggcccacacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaaaaaaaaaaaaaaaaaaaaaaaaaaaaaaaaaaaaaaaaaaaaaaaaaaaaaaagagaggggcgcgcgcgcgcgcgcgacgcgagcagcgcaacaacataaaagagcgcgagagagagaacgagcgaggcgagagccgcggcgcaaaggagagggggcgcgatctcacacaagcggggacgcgaagagacgaggaggacggagacgccagaaccgacgacgcggaggagaagagggggagcgcgcgcgcccacattgcatagaagaggaggcgagacagaaaggaagagacagagggagagagaaaaactaggccggcggcggggggaaaaagaacggggggcgcgccaggaaacagaggggaggagcgcccaacggggggcgagacacaccccacaaaaagagaggaggggaaaccgccgcccgcgcgcgacgaggggaggaggacaaaaacaaaaaacacagagaggagaggcgaggggtgagaacaacgaggagcgcaggcaacgcgagcgaggcgcgcccccccaccagcgagcggcggcagacaatgcagggaacaacccaagcaaagcggggagaggaagaaaaaacagcagggaagacaccggggcgcagaagcacacccaccggaagaagagaaagaaaaagaaagagaacaaaagcacgagaccgccgagacacggacaacaaagtcgggaggggcggaacaccacgggcgaagacactcggagccccacaccagcggggagagcacagaacaaaacgcacagacgagggcacgacagagcgaggacacaacaagggagggggaaggaaacgaagaagaaagaaaccaaccacggaggaaggcggagggggcagaggacggagcagacgcgccgggggagggaaaaaaaagagaggagcgagaaggaggggagccacacaacacaaggggcagcgaaacaacgaagaaagaagcagagacccccaaaaagaggaggaaagaacaccaccgaacacaaagcgaacgacgaggaaaccgaagcaaaacagcgctaccccgacgacgcccccgaccccgaaaaacgcagagggggagagaaacgccgcggcggcacgcgaagca

SEQ ID NO: 290309 - DNA, 1564 bp, Homo sapiens
ggtggtgggcccacacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaaaaaaaaaaaaaaccactacaaaaaaaacgccggggttttccgcgggggaaacgaacagggggttaattttccgcccctttttaagggggagaatggggcccaaagggggtttgaaggcgcgt

SEQ ID NO: 290310 - DNA, 1437 bp, Homo sapiens
tcgaaccttaggctaggtagcgaggcctgggtgttgggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggagacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaaaaaaaaaaatggggtttttcgggcgggaaaagata

SEQ ID NO: 290311 - DNA, 1160 bp, Homo sapiens
  misc_feature (1103)..(1103): n is a, c, g, or t
  misc_feature (1130)..(1131): n is a, c, g, or t
  misc_feature (1139)..(1139): n is a, c, g, or t
ggtggtgggcccacacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcaccatcctgctgctgctgctcttcctcagcaccatagagnctgtgctgctggctgggctgctgcccnnggcaaccntgggccaagagcgactgatag

SEQ ID NO: 290312 - DNA, 1338 bp, Homo sapiens
tcgaaccttaggctaggtagcgaggcctgggtgttgggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggagtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaaaaaaaaaaatggggtttttcgggcgggaaaagata

SEQ ID NO: 290313 - DNA, 1878 bp, Homo sapiens
tcgaaccttaggctaggtagcgaggcctgggtgttgggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggagacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcaggtcaacacctcttcctttctggtcccctctcgttttctgcatttccatctcttcccaatttcctgcagcagagggagtaaaggagtagccaagacagcatgggtcactcagggctccacaaagcgagtccaggatctatagaaagtttctgccctgccatcccccaacatacacacatgccctctttccatcctgtcttcctcccagacagcattccttgttggaattagtccttcacattctaaatactcagtatatgctcattcgcatctagtaggcatagagactatgtatctgcctcctgcctactccaggctcttccctccaacagttgtgagtgtaggtcccatcttggagtttgttggcgtggcggcgggggggaggttgctgtggtgatggtggggggtatgtctttgggtgttgtgtgcatggccctggagctgatctccacccttcctctcccctgctcaccccagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaa

SEQ ID NO: 290314 - DNA, 1967 bp, Homo sapiens
tcgaaccttaggctaggtagcgaggcctgggtgttgggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaaaaaaaaaaaaaaaaaaaaaaaaaaaaaaaaaaaaaaaaaaaaaaaaaaaaaaagagaggggcgcgcgcgcgcgcgcgacgcgagcagcgcaacaacataaaagagcgcgagagagagaacgagcgaggcgagagccgcggcgcaaaggagagggggcgcgatctcacacaagcggggacgcgaagagacgaggaggacggagacgccagaaccgacgacgcggaggagaagagggggagcgcgcgcgcccacattgcatagaagaggaggcgagacagaaaggaagagacagagggagagagaaaaactaggccggcggcggggggaaaaagaacggggggcgcgccaggaaacagaggggaggagcgcccaacggggggcgagacacaccccacaaaaagagaggaggggaaaccgccgcccgcgcgcgacgaggggaggaggacaaaaacaaaaaacacagagaggagaggcgaggggtgagaacaacgaggagcgcaggcaacgcgagcgaggcgcgcccccccaccagcgagcggcggcagacaatgcagggaacaacccaagcaaagcggggagaggaagaaaaaacagcagggaagacaccggggcgcagaagcacacccaccggaagaagagaaagaaaaagaaagagaacaaaagcacgagaccgccgagacacggacaacaaagtcgggaggggcggaacaccacgggcgaagacactcggagccccacaccagcggggagagcacagaacaaaacgcacagacgagggcacgacagagcgaggacacaacaagggagggggaaggaaacgaagaagaaagaaaccaaccacggaggaaggcggagggggcagaggacggagcagacgcgccgggggagggaaaaaaaagagaggagcgagaaggaggggagccacacaacacaaggggcagcgaaacaacgaagaaagaagcagagacccccaaaaagaggaggaaagaacaccaccgaacacaaagcgaacgacgaggaaaccgaagcaaaacagcgctaccccgacgacgcccccgaccccgaaaaacgcagagggggagagaaacgccgcggcggcacgcgaagca

SEQ ID NO: 290315 - DNA, 858 bp, Homo sapiens
tcgaaccttaggctaggtagcgaggcctgggtgttgggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaa

SEQ ID NO: 290316 - DNA, 1065 bp, Homo sapiens
agttagagaactaactgccaagatggagcgaagggaacatttaaccttgactttccacagtcctgaggttcccaaaataaaggggaaccggaaataccaaaggattatctccaatattccagggccttctttctcatctctgtctttaccatacttactggccttggctggctcttcagctcttggatccttaatcgaggaagcatgaccaccaacttggatctgaaggtatccatgctcagcttcatctcagctacctgcttgctcctctgcctcaacctgtttgtggcacaggttcactggcatactagggatgccatggagtcagatctcctatggacctattatcttaactggtgcagtgacatcttttacatgtttgctgggatcatctctcttctcaactacttaacttccagatcgcctgcctgtgatgaaaacgtcactgtgattccaacagagagatcaaggctgggggttggtccggtgactacagtatcacctgctaaagatgaagggccaaggtctgagatggaatctctaagtgtgagagagaaaaatttaccaaagtcaggactgtggtggtgataggaaaacctaactatagcttgtcttaaaagcaggggagaagctgagttgggaatggtcacataaattctgggaaactctcctaatatcatgtccatattacttgaggagacagcattaaagctgatgaaatgtcttttgcgtgcattggatccaaaatatatatgatagtcataaagtaaataactcacttaagaaaaacatttctaaaagaaaacaacaatgtttagagtcatgaatgaaagaaactagtgaaagatgcagtgtgtagaccagagacctctttgggtatcagggatctcatggaccagaatggcccgtggagaagaatgttaattacttctgtttggaattttctttattatgtgtggctttgggtatactcaggatggaaagcacttggacaaatactgttgaatctgaacttaatagcattaccagaaatggaataaatatcaatggatataagacctacta

SEQ ID NO: 290317 - DNA, 997 bp, Homo sapiens
ttccaagcaaaaaggatgtcatgtagcaagctctgctccatcatcctttgttcttaaatccttctctaagactctatctggcctttttaagggaaggtccctcactggactaaccacggtcttcctttcctcttcttcatgcagattatctccaatattccagggccttctttctcatctctgtctttaccatacttactggccttggctggctcttcagctcttggatccttaatcgaggaagcatgaccaccaacttggatctgaaggtatccatgctcagcttcatctcagctcaaattattcccttcccgtagggatcatctctcttctcaactacttaacttccagatcgcctgcctgtgatgaaaacgtcactgtgattccaacagagagatcaaggctgggggttggtccggtgactacagtatcacctgctaaagatgaagggccaaggtctgagatggaatctctaagtgtgagagagaaaaatttaccaaagtcaggactgtggtggtgataggaaaacctaactatagcttgtcttaaaagcaggggagaagctgagttgggaatggtcacataaattctgggaaactctcctaatatcatgtccatattacttgaggagacagcattaaagctgatgaaatgtcttttgcgtgcattggatccaaaatatatatgatagtcataaagtaaataactcacttaagaaaaacatttctaaaagaaaacaacaatgtttagagtcatgaatgaaagaaactagtgaaagatgcagtgtgtagaccagagacctctttgggtatcagggatctcatggaccagaatggcccgtggagaagaatgttaattacttctgtttggaattttctttattatgtgtggctttgggtatactcaggatggaaagcacttggacaaatactgttgaatctgaacttaatagcattaccagaaatggaataaatatcaatggatataagacctacta

SEQ ID NO: 290318 - DNA, 192 bp, Homo sapiens
agttagagaactaactgccaagatggagcgaagggaacatttaaccttgactttccacagtcctgaggttcccaaaataaaggggaaccggaaataccaaagggtgaggaggtatctaattgaaagtcagatgggaagaagagaacttacttaaaggcagggctacacagagcatcctaaagacagaaaaga

SEQ ID NO: 290319 - DNA, 352 bp, Homo sapiens
ttaaaagccaaaagaccattgcctattgaacctcacctcaaattattcccttcccgtagggatcatctctcttctcaactacttaacttccagatcgcctgcctgtgatgaaaacgtcactgtgattccaacagagagatcaaggctgggggttggtccggtgactacagtatcacctgctaaagatgaagggccaaggtctgagatggaatctctaagtgtgagagagaaaaatttaccaaagtcaggactgtggtggtgataggaaaacctaactatagcttgtcttaaaagcaggggagaagctgagttgggaatggtcacataaattctgggaaactctcctaatatc

SEQ ID NO: 290320 - DNA, 933 bp, Homo sapiens
agttagagaactaactgccaagatggagcgaagggaacatttaaccttgactttccacagtcctgaggttcccaaaataaaggggaaccggaaataccaaaggattatctccaatattccagggccttctttctcatctctgtctttaccatacttactggccttggctggctcttcagctcttggatccttaatcgaggaagcatgaccaccaacttggatctgaaggtatccatgctcagcttcatctcagggatcatctctcttctcaactacttaacttccagatcgcctgcctgtgatgaaaacgtcactgtgattccaacagagagatcaaggctgggggttggtccggtgactacagtatcacctgctaaagatgaagggccaaggtctgagatggaatctctaagtgtgagagagaaaaatttaccaaagtcaggactgtggtggtgataggaaaacctaactatagcttgtcttaaaagcaggggagaagctgagttgggaatggtcacataaattctgggaaactctcctaatatcatgtccatattacttgaggagacagcattaaagctgatgaaatgtcttttgcgtgcattggatccaaaatatatatgatagtcataaagtaaataactcacttaagaaaaacatttctaaaagaaaacaacaatgtttagagtcatgaatgaaagaaactagtgaaagatgcagtgtgtagaccagagacctctttgggtatcagggatctcatggaccagaatggcccgtggagaagaatgttaattacttctgtttggaattttctttattatgtgtggctttgggtatactcaggatggaaagcacttggacaaatactgttgaatctgaacttaatagcattaccagaaatggaataaatatcaatggatataagacctacta

SEQ ID NO: 290321 - DNA, 2432 bp, Homo sapiens
  misc_feature (1018)..(1018): n is a, c, g, or t
  misc_feature (1021)..(1021): n is a, c, g, or t
  misc_feature (1061)..(1061): n is a, c, g, or t
  misc_feature (1082)..(1085): n is a, c, g, or t
  misc_feature (1091)..(1091): n is a, c, g, or t
  misc_feature (1096)..(1097): n is a, c, g, or t
  misc_feature (1099)..(1099): n is a, c, g, or t
  misc_feature (1103)..(1103): n is a, c, g, or t
  misc_feature (1106)..(1106): n is a, c, g, or t
  misc_feature (1109)..(1109): n is a, c, g, or t
  misc_feature (1118)..(1118): n is a, c, g, or t
  misc_feature (1120)..(1120): n is a, c, g, or t
  misc_feature (1149)..(1149): n is a, c, g, or t
  misc_feature (1152)..(1152): n is a, c, g, or t
  misc_feature (1161)..(1161): n is a, c, g, or t
  misc_feature (1189)..(1189): n is a, c, g, or t
tacttactactggaccctgttttctctgagcagtttaatatggtttctttactattaatctaaatttgggctaattttatatatttttcaaaaggcattgattttctaaagagttttttaatcattaattcactctggtaatataagtaatacctttatatagtcatctaaactttccaaagcacttttacctattattctcagaacagtccaggaagtaggcaaaacagacattatcaccattttatgaggtattggatgctaaatgacttgctcagcgtctcataactggtaagtagcaggatcaggtctgaaatccatttcacctggccttagatccatctttgagggtctctttatctgataggcttctcgtcttggataggcaaaggaaggatgaactggagcagaggatgtcggccctgcaggagagcaggcgggagctgatggtccagctggaagagctgatgaagttgctgaaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaagcagaggaaggtgcagaggaagaagaagagaagatgcagaatgggaaagacagaggtaaaggcagctcagcaggactgctcgtttaaatggggagcccgagctcatggatcagccgccccccactttgtttctgcattcctccctgccaccacctttcccagagctttcggacccgaggtccctgtacctacttttcccatctgacagtcaggttttaccttccaggtgacaaggtcagtcgatcaccaagagcttcctcatttcctgatcctgggataggtagttgggatacaggaagtagatacaagtagaacacaaaagatgaccctttgactggagaagtttatgatctagttaataaagcaagaccaggccnggngcggtggctcacgcctgtaatcccagcactttgggaggcngaggcgggtggatcacgaggnnnncagacnagcanncnggcnaanatngtgaaaccncntctctactaaaaatacaaaaaattagccnggngtggtggcnggcgcctgtagtcccagctacttggggnttcttaatccttcaatacatgcaaggatgagtaaggcccatcccctgacctcaaggattttgcatcatggtaggaatggcagcagtaaagtaaattaagtaccactgaggagcactaattactgtagtgcttaatcaagcagtccctgctgaagtgatcaggagcagcttcccgacagtgatgttgggtcagacattacggaatgaataagatttggaagagaggtgagttataaaatgatggagcccacttaggaaaaatgaaccgtaagctggaggtccagacacaaagggcataagataggaggtgtggtactaaggacaggaatgtagatgggatctagagccgcactcgccgatagaaatgcaggccacgcacataatcaaaacatttctaacagcctcattgaaaaaccaaaaagtaataggcgtcattaattttaatagtatatcttacttaacctgatattttcaaaatattgtcctttcaacatgtaatcagtattaaaacatgatccagatactttgctgtttcctgcactaagtctttgaattccagtgtgtatgttacaattgccgtgcatctcagttcagcctagccctgtttcaggggctcggtagtcacgcgtggctagcggctgctgtgatagacagcgtaggtctcgattgcacaggcaagggtcagtgatgctagaaagtctgttgagatcattatgggatgatgaaatgaacatagctttgttttgagcggcagtttaaagttcgtagaacactctcatatttattaccttatatgatcctcagaatattgttgctgttactagtccccttttagaagagagaaaactgaggctaagtgacttgtctaaggttgcatatttggtaaatactggtgctgatactcaactttgaggccattgacttctatttcactgctttttcctcaccataaaagatgaaagagccaggtgcggtggctcacgactgtaatcccagcactttgggaggctgaggcaggtgggtcacttgaggtcaggagttcgagaccagcctggccaacatggtgaaactccatctctactaaaaatacaaaaattaactgggcatggtggcgatgcctgtaatcccagctatttaggaggctgaggcaggagaatcacttgaactggggaagcggaggttgcagttgagacaagatggcaccactgcactccagcctgggcgacagagtgagactccgtcac

SEQ ID NO: 290322 - DNA, 1381 bp, Homo sapiens
atataattagccaggcaattgagatcagattctagaaagtcttaattgttaggtcattggaaacccttggagagtttcaaatcatgattttggtaagttcagtagatgttaattaggtgatactggatgcatgatattttcttaatccttcaatacatgcaaggatgagtaaggcccatcccctgacctcaaggattttgcatcatggtaggaatggcagcagtaaagtaaattaagtaccactgaggagcactaattactgtagtgcttaatcaagcagtccctgctgaagtgatcaggagcagcttcccgacagtgatgttgggtcagacattacggaatgaataagatttggaagagaggtgagttataaaatgatggagcccacttaggaaaaatgaaccgtaagctggaggtccagacacaaagggcataagataggaggtgtggtactaaggacaggaatgtagatgggatctagagccgcactcgccgatagaaatgcaggccacgcacataatcaaaacatttctaacagcctcattgaaaaaccaaaaagtaataggcgtcattaattttaatagtatatcttacttaacctgatattttcaaaatattgtcctttcaacatgtaatcagtattaaaacatgatccagatactttgctgtttcctgcactaagtctttgaattccagtgtgtatgttacaattgccgtgcatctcagttcagcctagccctgtttcaggggctcggtagtcacgcgtggctagcggctgctgtgatagacagcgtaggtctcgattgcacaggcaagggtcagtgatgctagaaagtctgttgagatcattatgggatgatgaaatgaacatagctttgttttgagcggcagtttaaagttcgtagaacactctcatatttattaccttatatgatcctcagaatattgttgctgttactagtccccttttagaagagagaaaactgaggctaagtgacttgtctaaggttgcatatttggtaaatactggtgctgatactcaactttgaggccattgacttctatttcactgctttttcctcaccataaaagatgaaagagccaggtgcggtggctcacgactgtaatcccagcactttgggaggctgaggcaggtgggtcacttgaggtcaggagttcgagaccagcctggccaacatggtgaaactccatctctactaaaaatacaaaaattaactgggcatggtggcgatgcctgtaatcccagctatttaggaggctgaggcaggagaatcacttgaactggggaagcggaggttgcagttgagacaagatggcaccactgcactccagcctgggcgacagagtgagactccgtcac

SEQ ID NO: 290323 - DNA, 551 bp, Homo sapiens
tttgattttctaaagagttttttaatcattaattcactctggtaatataagtaatacctttatatagtcatctaaactttccaaagcacttttacctattattctcagaacagtccaggaagtaggcaaaacagacattatcaccattttatgaggtattggatgctaaatgacttgctcagcgtctcataactggtaagtagcaggatcaggtctgaaatccatttcacctggccttagatccatctttgagggtctctttatctgataggcttctcgtcttggataggcaaaggaaggatgaactggagcagaggatgtcggccctgcaggagagcaggcgggagctgatggtccagctggaagagctgatgaagttgctgaaggaagagcccgtggcccacgctcagttcttgtcattcttctcccaccacagcctcagctgctgcctccctgtgatgtcagaataggatgaggccaaaggcttgactttagcctagaatcagttttcagataaatttagcctaattgggtataaaagtcatctaaat

SEQ ID NO: 290324 - DNA, 447 bp, Homo sapiens
gacaaggaggtttttccattacaaagaagtgtatgacttagcttaaaccaagcagttcttcaaatgagcaatttcctgtggcagtcatcacttagccacagcccttttgtcaactttagatcttttttttgttcttgcagatggccaccagagctgcactggagagtgcatcttctgcttccatgtgtgggaagatcactgtgttctctgtgacccagtagtgtgaattgcttatctgtttctgcattaactcaaatttatcagtgattattgcctgaatacctcatgctttctgagatctacaggtacagatttagggttgaactctttctctaaataaatttaatccatgtgtgttatatgttgtatatcttcatttagtgactacgaaatgtctagctatgaaatgtgcatgttaattactcattaagcctttggatcgccttt

SEQ ID NO: 290325 - DNA, 3038 bp, Homo sapiens
  misc_feature (2516)..(2516): n is a, c, g, or t
  misc_feature (2539)..(2539): n is a, c, g, or t
agcggcggggggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaagaagcaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaaaaaaaaaaaaaaaaaaaaaaaaanaaaaaaaaaaaaaaaaaaaaaanaaaaaaaaaaaaaaaaaaaaaaaaagagagagggggcgcgcccccaaaaaatccccccggggggggcgccacatacgcagccgcacccgattctgtcgacaaaaggggcgcccctattgtggagggagttttatatatatcacatggaaggcgcagcggcgcccccgtttatataaaaaccgcctgtcactgagggagaaaaaacgacgctctctaacgtgatataaacatcttgggaagagcacactcctaccatcttcgcggaggggacggacacaactggtggggcaccacacacccccgccaaaaaagacatatacatacaccctctcgtagggggagaactaaatataacaaaataaacgcggcggggactgagctggggtcagcacacaaccactacccctacatatatgccgccgccgccggagagaacaaacatctgctcgccctcagaggaagggatacatatatatacgaagaacaatttctacagggg

SEQ ID NO: 290326 - DNA, 2894 bp, Homo sapiens
  misc_feature (2372)..(2372): n is a, c, g, or t
  misc_feature (2395)..(2395): n is a, c, g, or t
agcggcggggggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaagaagcaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaaaaaaaaaaaaaaaaaaaaaaaaanaaaaaaaaaaaaaaaaaaaaaanaaaaaaaaaaaaaaaaaaaaaaaaagagagagggggcgcgcccccaaaaaatccccccggggggggcgccacatacgcagccgcacccgattctgtcgacaaaaggggcgcccctattgtggagggagttttatatatatcacatggaaggcgcagcggcgcccccgtttatataaaaaccgcctgtcactgagggagaaaaaacgacgctctctaacgtgatataaacatcttgggaagagcacactcctaccatcttcgcggaggggacggacacaactggtggggcaccacacacccccgccaaaaaagacatatacatacaccctctcgtagggggagaactaaatataacaaaataaacgcggcggggactgagctggggtcagcacacaaccactacccctacatatatgccgccgccgccggagagaacaaacatctgctcgccctcagaggaagggatacatatatatacgaagaacaatttctacagggg

SEQ ID NO: 290327 - DNA, 2522 bp, Homo sapiens
  misc_feature (2000)..(2000): n is a, c, g, or t
  misc_feature (2023)..(2023): n is a, c, g, or t
ggccttaatacactggaccattgtctcggaaggcttcaatcatgttccagatatcaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaagaagcaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaaaaaaaaaaaaaaaaaaaaaaaaanaaaaaaaaaaaaaaaaaaaaaanaaaaaaaaaaaaaaaaaaaaaaaaagagagagggggcgcgcccccaaaaaatccccccggggggggcgccacatacgcagccgcacccgattctgtcgacaaaaggggcgcccctattgtggagggagttttatatatatcacatggaaggcgcagcggcgcccccgtttatataaaaaccgcctgtcactgagggagaaaaaacgacgctctctaacgtgatataaacatcttgggaagagcacactcctaccatcttcgcggaggggacggacacaactggtggggcaccacacacccccgccaaaaaagacatatacatacaccctctcgtagggggagaactaaatataacaaaataaacgcggcggggactgagctggggtcagcacacaaccactacccctacatatatgccgccgccgccggagagaacaaacatctgctcgccctcagaggaagggatacatatatatacgaagaacaatttctacagggg

SEQ ID NO: 290328 - DNA, 2739 bp, Homo sapiens
  misc_feature (2217)..(2217): n is a, c, g, or t
  misc_feature (2240)..(2240): n is a, c, g, or t
agcggcggggggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaagaagcaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaaaaaaaaaaaaaaaaaaaaaaaaanaaaaaaaaaaaaaaaaaaaaaanaaaaaaaaaaaaaaaaaaaaaaaaagagagagggggcgcgcccccaaaaaatccccccggggggggcgccacatacgcagccgcacccgattctgtcgacaaaaggggcgcccctattgtggagggagttttatatatatcacatggaaggcgcagcggcgcccccgtttatataaaaaccgcctgtcactgagggagaaaaaacgacgctctctaacgtgatataaacatcttgggaagagcacactcctaccatcttcgcggaggggacggacacaactggtggggcaccacacacccccgccaaaaaagacatatacatacaccctctcgtagggggagaactaaatataacaaaataaacgcggcggggactgagctggggtcagcacacaaccactacccctacatatatgccgccgccgccggagagaacaaacatctgctcgccctcagaggaagggatacatatatatacgaagaacaatttctacagggg

SEQ ID NO: 290329 - DNA, 2053 bp, Homo sapiens
  misc_feature (1531)..(1531): n is a, c, g, or t
  misc_feature (1554)..(1554): n is a, c, g, or t
tttttatattagttttggtattcctctgtattgacttcattctccaagtgaaattttattctttcttcttttattctatcccttccctcctgcccttttttctccccttttctctcctgtccacaagtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaagaagcaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaaaaaaaaaaaaaaaaaaaaaaaaanaaaaaaaaaaaaaaaaaaaaaanaaaaaaaaaaaaaaaaaaaaaaaaagagagagggggcgcgcccccaaaaaatccccccggggggggcgccacatacgcagccgcacccgattctgtcgacaaaaggggcgcccctattgtggagggagttttatatatatcacatggaaggcgcagcggcgcccccgtttatataaaaaccgcctgtcactgagggagaaaaaacgacgctctctaacgtgatataaacatcttgggaagagcacactcctaccatcttcgcggaggggacggacacaactggtggggcaccacacacccccgccaaaaaagacatatacatacaccctctcgtagggggagaactaaatataacaaaataaacgcggcggggactgagctggggtcagcacacaaccactacccctacatatatgccgccgccgccggagagaacaaacatctgctcgccctcagaggaagggatacatatatatacgaagaacaatttctacagggg

SEQ ID NO: 290330 - DNA, 2850 bp, Homo sapiens
  misc_feature (2328)..(2328): n is a, c, g, or t
  misc_feature (2351)..(2351): n is a, c, g, or t
agcggcggggggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaagaagcaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaaaaaaaaaaaaaaaaaaaaaaaaanaaaaaaaaaaaaaaaaaaaaaanaaaaaaaaaaaaaaaaaaaaaaaaagagagagggggcgcgcccccaaaaaatccccccggggggggcgccacatacgcagccgcacccgattctgtcgacaaaaggggcgcccctattgtggagggagttttatatatatcacatggaaggcgcagcggcgcccccgtttatataaaaaccgcctgtcactgagggagaaaaaacgacgctctctaacgtgatataaacatcttgggaagagcacactcctaccatcttcgcggaggggacggacacaactggtggggcaccacacacccccgccaaaaaagacatatacatacaccctctcgtagggggagaactaaatataacaaaataaacgcggcggggactgagctggggtcagcacacaaccactacccctacatatatgccgccgccgccggagagaacaaacatctgctcgccctcagaggaagggatacatatatatacgaagaacaatttctacagggg

SEQ ID NO: 290331 - DNA, 1649 bp, Homo sapiens
agcggcggggggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggtgagtagggacactctaccact

SEQ ID NO: 290332 - DNA, 1437 bp, Homo sapiens
agcggcggggggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggcaccagagctgcactggagagtgcatcttctgcttccatgtgtgggaagatcactgtgttctctgtgacccagtagtgtgaattgcttatctgtttctgcattaactcaaatttatcagtgattattgcctgaatacctcatgctttctgagatctacaggtacagatttagggttgaactctttctctaaataaatttaatccatgtgtgttatatgttgtatatcttcatttagtgactacgaaatgtctagctatgaaatgtgcatgttaattactcattaagcctttggatcgccttt

SEQ ID NO: 290333 - DNA, 1163 bp, Homo sapiens
agcggcggggggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcaggacgcattgagaagtactcaatatcacttctccggtaactcctgccaagaaagcataacctgaatctcatcccaaggaaacatcagacaaactccaatgaaggaatttctacaacctaactgaactttacacttcaaaagtgtcaataatatgaaagattaaaaaagatgaaatgttctaggttaaaagagtttaaagagacatgaaaagctgaatgaactcacaagccaggattttctgttgctataacggacgttattgggacaattggaaaaatctgaataaagtttatagactggat

SEQ ID NO: 290334 - DNA, 1067 bp, Homo sapiens
agcggcggggggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccacaccagagctgcactggagagtgcatcttctgcttccatgtgtgggaagatcactgtgttctctgtgacccagtagtgtgaattgcttatctgtttctgcattaactcaaatttatcagtgattattgcctgaatacctcatgctttctgagatctacaggtacagatttagggttgaactctttctctaaataaatttaatccatgtgtgttatatgttgtatatcttcatttagtgactacgaaatgtctagctatgaaatgtgcatgttaattactcattaagcctttggatcgccttt

SEQ ID NO: 290335 - DNA, 329 bp, Homo sapiens
cgagtaacgggagaagcaaggaagcccctggggtgggttggtcagggaagcccctttgagatagtctggggcatgagaagacctggccgtgacctcagtgtgttgtttctgcccatgctgccacaggttagcagaggagccggacacagaggaagctcaggtgagtacaaagagtcctctgcctccccacggcccctccctccttcctcagcatcttcccttcccctcccttcctgcagtcacaggtccctagccagggcagtcctaacaggtgaagatgcaagagcccaactgtcccttccctttgcccaccccagccatgtgccctc

SEQ ID NO: 290336 - DNA, 2749 bp, Homo sapiens
agcggcggggggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaaggaggaagagcaaaagcaggcagtaagtgaacttcggaatttcccgccggactctcgctcctttgcacgttcttcctttcctcatataaatgtttctcctcttctccccgcacatcatctctgaagagggttttatgtgtaaaacccccagcggttctccccatggtgttgtaaaatggcctaaaagttcaaggcatgtttacccagtagagcatgttcttacttaaaaccagagcttgtaagtacccatctgttgtgcgcattgaagtgtgcatgattagccaggctaccattgcattttcctgctctttcattctctgttgttgtgtgtctggagtgattttaattgcttgaaacaactttcagggtgctggggtgacctcatgtcatgaatgaatgtgcatgaaaatgaggacttcttttgctaactatagatgtcctttaacaaaattactgacgacgactgagacactgactccacttgcaatgatttcctgttcagaacctactccagacggagctcgggtttttctgagctgtgtggctattgcatggtgttcgggggaggtttatgtttgtttctgtttatcctgatagccactgacccactcaagaaagtcaattgcaggcttatctacaatattagcaccatatgtttatataacatagtaagatttcaaagcacacattttttaagctgaagctgagttttcgtttaccttggagcttttttatcctttgggagataaatacaaaacgtttaatttttaaaatttgcctttttttttttttccgagactccgtctccaaaaacaaacaaacaaaaaaaaactaccatcagagtgaacaggcaacctacagaatgggagaaaatttttgcaatctactcatctgacaaagggctaatatccagaatctacaaagaactcaaac

SEQ ID NO: 290337 - DNA, 2858 bp, Homo sapiens
  misc_feature (2336)..(2336): n is a, c, g, or t
  misc_feature (2359)..(2359): n is a, c, g, or t
agcggcggggggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaagaagcaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaaaaaaaaaaaaaaaaaaaaaaaaanaaaaaaaaaaaaaaaaaaaaaanaaaaaaaaaaaaaaaaaaaaaaaaagagagagggggcgcgcccccaaaaaatccccccggggggggcgccacatacgcagccgcacccgattctgtcgacaaaaggggcgcccctattgtggagggagttttatatatatcacatggaaggcgcagcggcgcccccgtttatataaaaaccgcctgtcactgagggagaaaaaacgacgctctctaacgtgatataaacatcttgggaagagcacactcctaccatcttcgcggaggggacggacacaactggtggggcaccacacacccccgccaaaaaagacatatacatacaccctctcgtagggggagaactaaatataacaaaataaacgcggcggggactgagctggggtcagcacacaaccactacccctacatatatgccgccgccgccggagagaacaaacatctgctcgccctcagaggaagggatacatatatatacgaagaacaatttctacagggg

SEQ ID NO: 290338 - DNA, 2948 bp, Homo sapiens
  misc_feature (2426)..(2426): n is a, c, g, or t
  misc_feature (2449)..(2449): n is a, c, g, or t
agcggcggggggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaagaagcaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaaaaaaaaaaaaaaaaaaaaaaaaanaaaaaaaaaaaaaaaaaaaaaanaaaaaaaaaaaaaaaaaaaaaaaaagagagagggggcgcgcccccaaaaaatccccccggggggggcgccacatacgcagccgcacccgattctgtcgacaaaaggggcgcccctattgtggagggagttttatatatatcacatggaaggcgcagcggcgcccccgtttatataaaaaccgcctgtcactgagggagaaaaaacgacgctctctaacgtgatataaacatcttgggaagagcacactcctaccatcttcgcggaggggacggacacaactggtggggcaccacacacccccgccaaaaaagacatatacatacaccctctcgtagggggagaactaaatataacaaaataaacgcggcggggactgagctggggtcagcacacaaccactacccctacatatatgccgccgccgccggagagaacaaacatctgctcgccctcagaggaagggatacatatatatacgaagaacaatttctacagggg

SEQ ID NO: 290339 - DNA, 2225 bp, Homo sapiens
  misc_feature (1703)..(1703): n is a, c, g, or t
  misc_feature (1726)..(1726): n is a, c, g, or t
catgagctcgcccctggtcttggctgacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaagaagcaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaaaaaaaaaaaaaaaaaaaaaaaaanaaaaaaaaaaaaaaaaaaaaaanaaaaaaaaaaaaaaaaaaaaaaaaagagagagggggcgcgcccccaaaaaatccccccggggggggcgccacatacgcagccgcacccgattctgtcgacaaaaggggcgcccctattgtggagggagttttatatatatcacatggaaggcgcagcggcgcccccgtttatataaaaaccgcctgtcactgagggagaaaaaacgacgctctctaacgtgatataaacatcttgggaagagcacactcctaccatcttcgcggaggggacggacacaactggtggggcaccacacacccccgccaaaaaagacatatacatacaccctctcgtagggggagaactaaatataacaaaataaacgcggcggggactgagctggggtcagcacacaaccactacccctacatatatgccgccgccgccggagagaacaaacatctgctcgccctcagaggaagggatacatatatatacgaagaacaatttctacagggg

SEQ ID NO: 290340 - DNA, 2439 bp, Homo sapiens
  misc_feature (1917)..(1917): n is a, c, g, or t
  misc_feature (1940)..(1940): n is a, c, g, or t
agcggcggggggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaagaagcaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaaaaaaaaaaaaaaaaaaaaaaaaanaaaaaaaaaaaaaaaaaaaaaanaaaaaaaaaaaaaaaaaaaaaaaaagagagagggggcgcgcccccaaaaaatccccccggggggggcgccacatacgcagccgcacccgattctgtcgacaaaaggggcgcccctattgtggagggagttttatatatatcacatggaaggcgcagcggcgcccccgtttatataaaaaccgcctgtcactgagggagaaaaaacgacgctctctaacgtgatataaacatcttgggaagagcacactcctaccatcttcgcggaggggacggacacaactggtggggcaccacacacccccgccaaaaaagacatatacatacaccctctcgtagggggagaactaaatataacaaaataaacgcggcggggactgagctggggtcagcacacaaccactacccctacatatatgccgccgccgccggagagaacaaacatctgctcgccctcagaggaagggatacatatatatacgaagaacaatttctacagggg

SEQ ID NO: 290341 - DNA, 1857 bp, Homo sapiens
  misc_feature (1335)..(1335): n is a, c, g, or t
  misc_feature (1358)..(1358): n is a, c, g, or t
caaaaaactcaagccttactggttctccctacctcctgatagctacctacctagactgcttggcagacacagttctgtaggctactttcttatcaagagttggcaattagaagaggcccttggagaggaggtgggagtgctccttaaagtcctcatcggaatggaattgctgaccgggttcattaggctatggatttgcagcaagacttggattctattgcaatcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaagaagcaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaaaaaaaaaaaaaaaaaaaaaaaaanaaaaaaaaaaaaaaaaaaaaaanaaaaaaaaaaaaaaaaaaaaaaaaagagagagggggcgcgcccccaaaaaatccccccggggggggcgccacatacgcagccgcacccgattctgtcgacaaaaggggcgcccctattgtggagggagttttatatatatcacatggaaggcgcagcggcgcccccgtttatataaaaaccgcctgtcactgagggagaaaaaacgacgctctctaacgtgatataaacatcttgggaagagcacactcctaccatcttcgcggaggggacggacacaactggtggggcaccacacacccccgccaaaaaagacatatacatacaccctctcgtagggggagaactaaatataacaaaataaacgcggcggggactgagctggggtcagcacacaaccactacccctacatatatgccgccgccgccggagagaacaaacatctgctcgccctcagaggaagggatacatatatatacgaagaacaatttctacagggg

SEQ ID NO: 290342 - DNA, 1571 bp, Homo sapiens
agcggcggggggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggttgtgtttcatctgtgtcctgagtgttaatctgtttgatcagtaacagcacctgggccagtttcctcatggatgcctaccaaataaggggtgtgatatagtaaaatcttaacactaacatttatgccaggatggcaagaatgttgtgcttcatcacttgattttaaaagcagaatttttaaaaattccaggaaacaaagatagtacatttgaaatggtctcttttattcagtaaaatggaatgttgcagtgctctcttttcaaagcaaaaagtgagtttctttttattttaaaactgtacaggctgggcacgatggctcacacctgtaatcccagcactttgggaggccgaggcaggcggatcacgaggtcaggagatcgagatcatcctggctgacacagtgaaaccccgtctctactaaaaatacaaaaaaaaa

SEQ ID NO: 290343 - DNA, 1387 bp, Homo sapiens
  misc_feature (865)..(865): n is a, c, g, or t
  misc_feature (888)..(888): n is a, c, g, or t
gcaaggctggacagcaatggccctcagagaacagaacaggctcaggaggggccaggcagtgctcgagcctcgggtgagcaagcgcagggcttttcaaagcagaccatctgcaggagggggaccgccctcactcaaggcgcagtcatgttcccttggggaactttcagagctgagtgggctttgcccccctcatgtaactgctccctggatttaaggagttttgattccattttttaatgactttccttctcctgagaagcatctgtctccatggctgcctcgggttggctacagtagtagaaagtatgactctaccctgctgtcatacctgggtgggaaaagtcaacaaacgagtaacgggagaagcaaggaagcccctggggtgggttggtcagggaagcccctttgagatagtctggggcatgagaagacctggccgtgacctcagtgtgttgtttctgcccatgctgccacaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaaaaaaaaaaaaaaaaaaaaaaaaaaaaaaaaaaaaaaaaaaaaanaaaaaaaaaaaaaaaaaaaaaanaaaaaaaaaaaaaaaaaaaaaaaaagagagagggggcgcgcccccaaaaaatccccccggggggggcgccacatacgcagccgcacccgattctgtcgacaaaaggggcgcccctattgtggagggagttttatatatatcacatggaaggcgcagcggcgcccccgtttatataaaaaccgcctgtcactgagggagaaaaaacgacgctctctaacgtgatataaacatcttgggaagagcacactcctaccatcttcgcggaggggacggacacaactggtggggcaccacacacccccgccaaaaaagacatatacatacaccctctcgtagggggagaactaaatataacaaaataaacgcggcggggactgagctggggtcagcacacaaccactacccctacatatatgccgccgccgccggagagaacaaacatctgctcgccctcagaggaagggatacatatatatacgaagaacaatttctacagggg

SEQ ID NO: 290344 - DNA, 602 bp, Homo sapiens
ctagaggatccccccattccattccagcgtcccttctcaggtggaaggtatcgctggtttttagagagatggtggcataagaggagtctgggagaccacacccctaagcttcatcttgcttctgctgctaactttggaggggttgccctttcagggagggatgcctgctggctgccctgatctctctgtggaggaaggcacagagtatgtgggcggtgatctcaagtttagtcgtgggactcaggatttagagggaacgagggctcagagaggtggcacagatttgcctgtattattcaggttttttgttttgtcctcttcagatttttttttttttgcggggggggcagagggggatagtcatccattctaccccaatccccagtttcccagtgggttgggtggaggaaaggagggacaggaggctctaggagttatgtgggttcctgaaggagcaatcttgatctgaaccagatggttcactgcttcagcaacccccttcccagccctcccccttggctgtgaattggatgcttttaaccttgtaacttgagaatggaggaagggaggccagggggccaactgtctgtgtgggtgtttat

SEQ ID NO: 290345 - DNA, 806 bp, Homo sapiens
acctggtagcactacatggctcgcagctatggcactggacacacagatctaggacattttcatcatcacagaaagttctattggacagcactgaatagcacgagcccatttttataattaaaaaaaagggtgtacacttataaaagcagcagaaatatttggaaggaaaccatgcccctgctctgaaagaacaggacggtagagcaagaagaaaatgaagcaggctgggactccctgagcagcgcagcccctttacagaaaacctgtttgaagaggcatcaaaactgttcatcttggccggaagcggtggctcatgcctgtaatcccagcacttcgggaggctgagaatctaaatcccatgaagacagggacactgctttgctgcctgctatgtctccagcacttagaacagtgcctggcacatcacagagcctcaataatatttgctgaatgaatgagcagcaccccgccctttaacagtggagagaaaccatcatcgacgaaggatctataccagagctgcaactgccaccagcgacccaagacagagaaatgccaccttgcgttactaaagggctcatgacaccatatacaacagctgaatccccaagaggagtgtggctgaggagtgagacgaaggtctctgggacactttcagaaggatgagactttgtccagccagtcctcattatgccaggcaaaggaactgcctgtactcataactgtggaaggggaaccacataccatgggcaggtggtccatgggggcagtgattaagagcaagtcctagaactcacactgccttt

SEQ ID NO: 290346 - DNA, 2705 bp, Homo sapiens
tgccaccgtcttctgtctctacctccctcctggctggccaatggctctgtgttcctgggcctgctgctggctgtccagagtaggggttgcttagagctgtgtgcatccctgcgggtggtgtgggagtgggcggttgtctaaaggcaggtcccctctactgataaacaaggaccggagatagacctagaggctgacattcttggctcccccagcctacaccccccccacctcgatttcccacagagccctagggacgggtagccagctctgtggcatggtatctggaggcaggccagcaacctgatgtgcatgccacggcccgtccctctccccactcagagctgcagtagcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgtt

SEQ ID NO: 290347 - DNA, 3947 bp, Homo sapiens
tccccaaggctaggaggccaacctactaacaggtgggtgggtatggtgtgtggtttcactcagttcttctcatggggtttctctgagctccattcataccagaaagggagcaggagagagaggacaagtggatccaacagccttcgctccaggggaatcagggcatcgcctccttttctgggaggacactcccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaacccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtgaaaaaaaaaa

SEQ ID NO: 290348 - DNA, 3713 bp, Homo sapiens
agactcttgggggattccttagtgagtgagttcactgctcaaagaagggctttgccacttctgcagggaagccagccacgggccagcagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaacccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtgaaaaaaaaaa

SEQ ID NO: 290349 - DNA, 2782 bp, Homo sapiens
tccccaaggctaggaggccaacctactaacaggtgggtgggtatggtgtgtggtttcactcagttcttctcatggggtttctctgagctccattcataccagaaagggagcaggagagagaggacaagtggatccaacagccttcgctccaggggaatcagggcatcgcctccttttctgggaggacactcccttctgatggtgaatgggaactcccttcctcctgcagcagcctgcctgcagctgtcctggtagaacagtgtggacattgcagaagctgtcactgccccagaaagaaagcaccccagagccaaggcaaagagcttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaacccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtgaaaaaaaaaa

SEQ ID NO: 290350 - DNA, 4095 bp, Homo sapiens
tgccaccgtcttctgtctctacctccctcctggctggccaatggctctgtgttcctgggcctgctgctggctgtccagagtaggggttgcttagagctgtgtgcatccctgcgggtggtgtgggagtgggcggttgtctaaaggcaggtcccctctactgataaacaaggaccggagatagacctagaggctgacattcttggctcccccagcctacaccccccccacctcgatttcccacagagccctagggacgggtagccagctctgtggcatggtatctggaggcaggccagcaacctgatgtgcatgccacggcccgtccctctccccactcagagctgcagtagcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaacccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtgaaaaaaaaaa

SEQ ID NO: 290351 - DNA, 3669 bp, Homo sapiens
aaaaaatactgttggcagcagcacaatgtttgggctaagacctggtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaacccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtgaaaaaaaaaa

SEQ ID NO: 290352 - DNA, 3689 bp, Homo sapiens
tgccaccgtcttctgtctctacctccctcctggctggccaatggctctgtgttcctgggcctgctgctggctgtccagagtaggggttgcttagagctgtgtgcatccctgcgggtggtgtgggagtgggcggttgtctaaaggcaggtcccctctactgataaacaaggaccggagatagacctagaggctgacattcttggctcccccagcctacaccccccccacctcgatttcccacagagccctagggacgggtagccagctctgtggcatggtatctggaggcaggccagcaacctgatgtgcatgccacggcccgtccctctccccactcagagctgcagtagcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaacccccagcataaaataaacccctatcaaaatgtcagaggacatggcaaggtaaacttagcattttcaactttagaaccgggtcagcttgagtgtactgctgacaactaaactcacaggctgcaaagcagacctctgatgaagatgcctgttatttcacatcactgtctttttgtgtatcatagtctgcaccttacaaatattaataaatgttccaataataggtgaaaaaaaaaa

SEQ ID NO: 290353 - DNA, 2422 bp, Homo sapiens
agcggagagcgccgccgccgccgctgctgcagcagcagctgctctgcaaagtggtggccggggccaggtccggggtgccctccctcccaccttctcacgccatgagccagggaagtccgggggtacctgggccccacatgatgtaccgacacgaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaacccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtgaaaaaaaaaa

SEQ ID NO: 290354 - DNA, 2601 bp, Homo sapiens
tgccaccgtcttctgtctctacctccctcctggctggccaatggctctgtgttcctgggcctgctgctggctgtccagagtaggggttgcttagagctgtgtgcatccctgcgggtggtgtgggagtgggcggttgtctaaaggcaggtcccctctactgataaacaaggaccggagatagacctagaggctgacattcttggctcccccagcctacaccccccccacctcgatttcccacagagccctagggacgggtagccagctctgtggcatggtatctggaggcaggccagcaacctgatgtgcatgccacggcccgtccctctccccactcagagctgcagtagcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgtt

SEQ ID NO: 290355 - DNA, 1705 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttga

SEQ ID NO: 290356 - DNA, 1963 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaaagcaaaaagaacttttacctcggcatccagcccaacccctaaagactgacaatatccttcgagctcctttgaaagcaccctaaacagccatttccattttaatagttggatgcggattgtacccttcaatctgaaagtcttcagctttgaagtcatcaattttctcaacttttcgaagaatcctgagctttgggaaaggtctgggttctcgctgaagctaaaaacaaaataaggccattattttgccataattgtacgacctgttgtaattgctcctcatgtccgtgaaacaagtacacaggatgtgatcaacaaagttctattttacaggagtatgatcctgtcgataccttgccgtaggttatgtaacatgattggagcgcaaccagctgttctcttgcacagatcgagagtgaggggtattttgtgacattacacagcatcaggagcctggtgcctcatcaggtgtaagttcttataaccactcttggcaaatttattaaagacaggaacacagtcaatctgtaa

SEQ ID NO: 290357 - DNA, 1561 bp, Homo sapiens
agctcgaactccggacctcaggtgatccacccatctcagcctcccaaagtgctgggattacagatgtgagccaccgaacctggcccagaactcttagaagtagaatctcagggttgaaagagtttttaggattttcgacagttatggtagagtattattggtcactataagatgttagtgggaatggaactactggctgttttccaactgactgttccgtcagggtggggagaggtctcagcacgaggccccgccgaaatgttggtaagtggtcagccaagtgggccgctcactcccggttcacccactgtgttcctgtcagtgaagcaaacatccccatttggcaggagaagaagctgccggaggtcacactgctagtgattggtggcccaggggtagggcagccttctttcctctgcagttcactgctccagaaccatctccagcctcatagctcaccgtggacagccctgcggtgtggcgctgatgtacagagtgatgccaggcgttcatctccccactgagctcctgctgagtgtttgcctggggccaggtcctccttccgggaagtcattttagctggaaagaacagggtgggggcgggtggcaagggatcagagcatgagcgtttgagggcttcgtcaggggcagtgaggagcctctaaaggactctacatttaggaatgacagagtcaaacaatttaacaaagccctaaaggtccctgccaggaaagaatgagccccatgtatcaccataagcaacttcttagaaacataacccacccctgtcatcccagcactttgggaggccaaggagggaggattgcttgaagccaggagctcgagatcaacctggtcaacatagtgagaccccatctctacaaaaataaaaataaattagccgggcatagtggcacatacctggagtcccagctactcaggaggctgaggcaggaggatcacataagccggggagactgaggctgcagtgagctatgatggcatcactgcactccagcctgggcaacagagtgagaccttgtctctaaaaaaagaataataaattttaaaaaacaaaatataacccaccttataattgattcaggcctcttcccctcctgtcacgttgccaggatcccaggatgctggtatcctgcatagatttcaggtacatcactgatgtcctgactgaggaggatgccctaggtgagtttggaagctttctgggatacacgatgtgcacacacagtagtggcatgctttgtttcctaaaagagtgagtgatgctttttatttcttccagaaatactgcagaaaggtcaaattggtaaaaaagaaagaggtgggttgtaagaaaattttcttcattgtttttgctaacattgtccacttttgagtgcccctgtccttttggggtacaccattgtcttcccaaatgccctgtgctgagcagctaggccctcaaatcaacattcaagtctgcatggtgaagcctgctgggtatgacctctgactgcagagtttgcttcagccactgctgaaaggaagtttggctttagga

SEQ ID NO: 290358 - DNA, 926 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctaggtgagtttggaagctttctgggatacacgatgtgcacacacagtagtggcatgctttgtttcctaaaagagtgagtgatgctttttatttcttccagaaatactgcagaaaggtcaaattggtaaaaaagaaagaggtgggttgtaagaaaattttcttcattgtttttgctaacattgtccacttttgagtgcccctgtccttttggggtacaccattgtcttcccaaatgccctgtgctgagcagctaggccctcaaatcaacattcaagtctgcatggtgaagcctgctgggtatgacctctgactgcagagtttgcttcagccactgctgaaaggaagtttggctttagga

SEQ ID NO: 290359 - DNA, 566 bp, Homo sapiens
tgacgggattgcaggcataagctataagccaccatgcctggcctgtttctgtttttatttatttatttatttatttatctatgtatttatttatttttgagatagagtcccactctgttgcccaggctggagtgcagtggtgtgatctcggctcactgcaacctctgcctcctaggttcaagcaattctcctgcctcagcctcctgagtagggactacaggcacaaaccaccacacctggctcatttctctgttttcagtagagacggggtttcaccatgttggccaggctggtcttggtcccaaagtcctgggtttacaggcatgagccatcacacccagccctctttttcatttctaaaaagtgcttttgtactttgcttcctaaccagattggtccagaaaagggcgtggtgcacctggcgacagcggccgtcctaaacgcggtgtgggacttgtgggccaagcaggagggaaaggtaacccctctcacaaacgctcaggaggctcctgggagctgtacgacactgactttccctacgcacagaggaaagacagacacactgc

SEQ ID NO: 290360 - DNA, 1985 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaagtggttttgcatcttttccttgcttaatctaagcatattattagagaagtcacaccatgctgaagctaatgagggcaaaatggtagtccatagattattttaaaataaccctttaaggttataaaagtttaa

SEQ ID NO: 290361 - DNA, 2808 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacaggtgagtgacgcccccaacaggtggatgacgtccccttggggtcagtacacgctgaccagtgaccgaggacacagttgtgtgttaggctccatcacctgctgtactttgagttgggaaattttcatcatcttagaaactgggtcattttatcagagtctagagtcagatatagaaaaagtttgtggctatttctccaatttatatgactaaggtcgggtatctttttcaaagtgtctaattgaaattgaaaaggcagcaatttaaagttgctattgcaagggcagaaaatggtcttaagaaagccagctttcaaattgaataaacatgactgcgttcactttttgagcttataaatgaagcccgagtgcctgccaaaacctgctgcagtcagcccacgagcagagcagcgtgaggagctgattctcagttttcccggcaaaaggagcaatactgctctgccgtggttccgtgttgtcatctgtgccacctgctcatcactgtcaccgtatttcatcctgatgcttcatctcccacttatcagtcgctgtgacagtcattccctcataaatggcgagccagtgtgattttgacctgactcacactgttgcattagcagatttgtaaagaagtgagcacaaggtccctgcccacgctataaaagctcgcctcatgcccagcgagaacaaagaagaaatacagtctgggcttcctgacggccactgatgaataattattggcatagagtggctgcgttgccaggtttagagatcctgaaggccaaggctgactcttctgttggtgttattttcaattctatttccagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaagtggttttgcatcttttccttgcttaatctaagcatattattagagaagtcacaccatgctgaagctaatgagggcaaaatggtagtccatagattattttaaaataaccctttaaggttataaaagtttaa

SEQ ID NO: 290362 - DNA, 2079 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaaagcaaaaagaacttttacctcggcatccagcccaacccctaaagactgacaatatccttcgagctcctttgaaagcaccctaaacagccatttccattttaatagttggatgcggattgtacccttcaatctgaaagtcttcagctttgaagtcatcaattttctcaacttttcgaagaatcctgagctttgggaaaggtctgggttctcgctgaagctaaaaacaaaataaggccattattttgccataattgtacgacctgttgtaattgctcctcatgtccgtgaaacaagtacacaggatgtgatcaacaaagttctattttacaggagtatgatcctgtcgataccttgccgtaggttatgtaacatgattggagcgcaaccagctgttctcttgcacagatcgagagtgaggggtattttgtgacattacacagcatcaggagcctggtgcctcatcaggtgtaagttcttataaccactcttggcaaatttattaaagacaggaacacagtcaatctgtaa

SEQ ID NO: 290363 - DNA, 2435 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaaagcaaaaagaacttttacctcggcatccagcccaacccctaaagactgacaatatccttcgagctcctttgaaagcaccctaaacagccatttccattttaatagttggatgcggattgtacccttcaatctgaaagtcttcagctttgaagtcatcaattttctcaacttttcgaagaatcctgagctttgggaaaggtctgggttctcgctgaagctaaaaacaaaataaggccattattttgccataattgtacgacctgttgtaattgctcctcatgtccgtgaaacaagtacacaggatgtgatcaacaaagttctattttacaggagtatgatcctgtcgataccttgccgtaggttatgtaacatgattggagcgcaaccagctgttctcttgcacagatcgagagtgaggggtattttgtgacattacacagcatcaggagcctggtgcctcatcaggtgtaagttcttataaccactcttggcaaatttattaaagacaggaacacagtcaatctgtaaaaaaaaaaaaaaaaaaaaaaaaaaaaaaaaaaaaaaaaaaaaaaaaaaaaaaaaaaaaaaaaaaaaaaaaaaaaaaaaaggggggggccccccgaagaagccactcctccccagggggcggcgccaatagctacccgccccccccacggtttgttgtgagaacaaaggcggcgcccactttgagaggggtcattattatattaaagccgagcagccggcgcgcgcccgtgtttaaaacaaagcggcagagcggacgaaaaaaacccggtacggggaggctttttagagagagaacccaccttcctagggggggggaaaaaaaggggacaactctccgacaagatattaagccctta

SEQ ID NO: 290364 - DNA, 2093 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatggtaagcgcggacgccatggtaagcgcggacgccatggtaagcgcggacgccatggtaagcgcggacgccatggtaagcgcggacgccatggtaagcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaagtggttttgcatcttttccttgcttaatctaagcatattattagagaagtcacaccatgctgaagctaatgagggcaaaatggtagtccatagattattttaaaataaccctttaaggttataaaagtttaa

SEQ ID NO: 290365 - DNA, 2164 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatgcacacggaccctgactactcggctgcctatgtcgtcatagaaactgatgcagaagatggaatcaaggggtgtggaattaccttcactctgggaaaaggcactgaagttgcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaagtggttttgcatcttttccttgcttaatctaagcatattattagagaagtcacaccatgctgaagctaatgagggcaaaatggtagtccatagattattttaaaataaccctttaaggttataaaagtttaa

SEQ ID NO: 290366 - DNA, 1946 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaagtggttttgcatcttttccttgcttaatctaagcatattattagagaagtcacaccatgctgaagctaatgagggcaaaatggtagtccatagattattttaaaataaccctttaaggttataaaagtttaa

SEQ ID NO: 290367 - DNA, 2023 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatgggatcccaggatgctggtatcctgcatagatttcaggtacatcactgatgtcctgactgaggaggatgccctagaaatactgtagacatgttaaattcgtaaaataagaagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaagtggttttgcatcttttccttgcttaatctaagcatattattagagaagtcacaccatgctgaagctaatgagggcaaaatggtagtccatagattattttaaaataaccctttaaggttataaaagtttaa

SEQ ID NO: 290368 - DNA, 1588 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaactgcttaagaagctaaaagagcacacccatctgaaga

SEQ ID NO: 290369 - DNA, 1408 bp, Homo sapiens
gtgacttatctgaagatgaggaaagagcaagaggttactaaaaaacatatctgtgaattgttgacagagacggtcacttctgcagaaactccagatgcccttgccaagtccaggtacaggtctaaactagcaaaccaaatgcattttctaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaagtggttttgcatcttttccttgcttaatctaagcatattattagagaagtcacaccatgctgaagctaatgagggcaaaatggtagtccatagattattttaaaataaccctttaaggttataaaagtttaa

SEQ ID NO: 290370 - DNA, 1012 bp, Homo sapiens
gcggccgcctactactactaaattcgcggccgcgtcgacttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaagtggttttgcatcttttccttgcttaatctaagcatattattagagaagtcacaccatgctgaagctaatgagggcaaaatggtagtccatagattattttaaaataaccctttaaggttataaaagtttaa

SEQ ID NO: 290371 - DNA, 1235 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggtaggaaaacggctgctgctgctgtggcagcttatttttctgtttagttttccagagtgctggggacagatcctaaaatttcttcacttgttccctcttgcatttcctgttgaagtagctgaaataattgtaatgtgtgacaaatacaggggttacagacctgacattcctttttctacttcagcttatactttgcccttatttctgtttgttttagataaagtaagctgctaaaagttgaagggctaccagcaatttgaaggttaatagacatggttcctatg

SEQ ID NO: 290372 - DNA, 543 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctgggcctggctttttttttttttttttttttggtatttttagtagagatgaggtttcaccacattggccaggcctgtctcgaactcctgacctcagaccatctgcccgccttggcctcccaaagtgctgga

SEQ ID NO: 290373 - DNA, 929 bp, Homo sapiens
  misc_feature (613)..(613): n is a, c, g, or t
  misc_feature (628)..(628): n is a, c, g, or t
  misc_feature (660)..(660): n is a, c, g, or t
  misc_feature (662)..(662): n is a, c, g, or t
  misc_feature (677)..(677): n is a, c, g, or t
  misc_feature (693)..(693): n is a, c, g, or t
  misc_feature (716)..(716): n is a, c, g, or t
  misc_feature (743)..(743): n is a, c, g, or t
  misc_feature (760)..(760): n is a, c, g, or t
  misc_feature (765)..(765): n is a, c, g, or t
  misc_feature (767)..(767): n is a, c, g, or t
  misc_feature (769)..(769): n is a, c, g, or t
  misc_feature (810)..(810): n is a, c, g, or t
  misc_feature (819)..(819): n is a, c, g, or t
  misc_feature (842)..(842): n is a, c, g, or t
  misc_feature (861)..(861): n is a, c, g, or t
  misc_feature (928)..(928): n is a, c, g, or t
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataagagcagatccaccgtgcagggcacgctcacgaatggcttggtcnaagaaacaagggcgnggtgccccatgagcgaccgcggccgatccatnanacgcggtgtgagagncattgtgggccaagcnggaggagaacaagcctgtctggncagattccttgtggaccatggctcccnaggatgactggtatcangaatngntntcaggaccatcccatagctgtccatgcactagaggcggctnccctcgccntcctgccgaccggaaccacttgntcccccagcccacagagangcccatgaaggccccacgagctccgctgcttcaaccgccactcgtgcgcatggctgagggtccttcng

SEQ ID NO: 290374 - DNA, 391 bp, Homo sapiens
gccaaatcatccgagacatgattggaccggaaaagactttggtaaatatcctctcacaccactaagaagcagtagcctttgtccagggctaaatacaactcgtttcaagattaaagaacattgggaatttaaaaagttaattgtcagaggaagtacacttctgtggtcttgcagtaggcgagctcaaacaaaaataagcaaagggactaatagttttacgttttttaattctgcagaactagttaagtaagtttggggttaaggatcctttcttactaacacagatgtacctgagcaaacagttttcccattggtgctctggtgtgtcaatcatgtaatctcccctcctagctcctcaggtaggagggtgtcagggggccattactgaaga

SEQ ID NO: 290375 - DNA, 482 bp, Homo sapiens
ggcccctgtggcattgtctgtcctcatgtgacatcattctcatggttcttttcgggtttctcacactggcattgtttcggcggggaactcttctcctgcacacacggaccctgactactcggctgcctatgtcgtcatagaaactgatgcagaagatggaatcaaggggtgtggaattaccttcactctgggaaaaggcactgaagttgtggtgagttgaagattctctcgaggttccagaatgcttaattttcagatgagattctaatttagattcttagattcattagaatcttgatttagattgagttctgatcttgtttttatctgtatttacactgctcaaagtgagtaaaaagtttcatggtttgttacttgtttcactgggagaaatttaaaagtgacagaatttggcctctctccttgcaatcatctctagcctgttagaaaatccttggctgttagtctgtttctctgtgtca

SEQ ID NO: 290376 - DNA, 706 bp, Homo sapiens
catggtaacacagctaagccttggccaacactgtcaattgagtggtactcgctccttctgctttaagttagcaccacgtgaataatctgacttcaggcatcattgccccgatctgattccctcctcctagggtgtgtgagtatgttgaccacctgcatgagcatttcaagtatcccgtgatgatccagcgggcttcctacatgcctcccaaggtaagctgtggcctgagggcccctgtagaagagatgctgccagccactgccacgcctgtctcgtgaactagactgtggagcaccaagctttgactcctgtttgtttgcaatatccactaacaaacggttcttcagtttgtctgtatcaaaatcctcaggcctgagggccagggcttggaggttcaattgcctctgacaaggcttctgtaatactagcctttcctcactagtggagatcttaacatttgcactccttgtgcaaaaaaacctggcaccatctagcaagttagtgacctaaaaagtttggactacaattgtgtggctggggccatttattctgatcatgttcaagagatcatggctcattttcaccaacagaggtcaaactattatcaaagagtttgatgagttaactaactctggcaagtagccagtaaaatatgttcctctgccctattatttccaacagtctccaaacttattttaaaaatatt

SEQ ID NO: 290377 - DNA, 1263 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggcctcttcccctcctgtcacgttgccaggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggtaggaaaacggctgctgctgctgtggcagcttatttttctgtttagttttccagagtgctggggacagatcctaaaatttcttcacttgttccctcttgcatttcctgttgaagtagctgaaataattgtaatgtgtgacaaatacaggggttacagacctgacattcctttttctacttcagcttatactttgcccttatttctgtttgttttagataaagtaagctgctaaaagttgaagggctaccagcaatttgaaggttaatagacatggttcctatg

SEQ ID NO: 290378 - DNA, 751 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggggtgaacaactggatgctgaggaggaaaaaactgggcaaattaaaggggaatgagcttcagaccccatgcagagctggctgtgagtccgggtttcactgctcaccagctgcatgaccttgagcatgtgacttccccactctgagctgcggtggcctcagtgcaacacctgggtggcggttaaaaacctcgtgatccacaaatgaaggcccttgttattagttggcaaaaaattaaggaaaaacaaagaacac

SEQ ID NO: 290379 - DNA, 1795 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgca

SEQ ID NO: 290380 - DNA, 2620 bp, Homo sapiens
agctcgaactccggacctcaggtgatccacccatctcagcctcccaaagtgctgggattacagatgtgagccaccgaacctggcccagaactcttagaagtagaatctcagggttgaaagagtttttaggattttcgacagttatggtagagtattattggtcactataagatgttagtgggaatggaactactggctgttttccaactgactgttccgtcagggtggggagaggtctcagcacgaggccccgccgaaatgttggtaagtggtcagccaagtgggccgctcactcccggttcacccactgtgttcctgtcagtgaagcaaacatccccatttggcaggagaagaagctgccggaggtcacactgctagtgattggtggcccaggggtagggcagccttctttcctctgcagttcactgctccagaaccatctccagcctcatagctcaccgtggacagccctgcggtgtggcgctgatgtacagagtgatgccaggcgttcatctccccactgagctcctgctgagtgtttgcctggggccaggtcctccttccgggaagtcattttagctggaaagaacagggtgggggcgggtggcaagggatcagagcatgagcgtttgagggcttcgtcaggggcagtgaggagcctctaaaggactctacatttaggaatgacagagtcaaacaatttaacaaagccctaaaggtccctgccaggaaagaatgagccccatgtatcaccataagcaacttcttagaaacataacccacccctgtcatcccagcactttgggaggccaaggagggaggattgcttgaagccaggagctcgagatcaacctggtcaacatagtgagaccccatctctacaaaaataaaaataaattagccgggcatagtggcacatacctggagtcccagctactcaggaggctgaggcaggaggatcacataagccggggagactgaggctgcagtgagctatgatggcatcactgcactccagcctgggcaacagagtgagaccttgtctctaaaaaaagaataataaattttaaaaaacaaaatataacccaccttataattgattcaggcctcttcccctcctgtcacgttgccaggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaagtggttttgcatcttttccttgcttaatctaagcatattattagagaagtcacaccatgctgaagctaatgagggcaaaatggtagtccatagattattttaaaataaccctttaaggttataaaagtttaa

SEQ ID NO: 290381 - DNA, 1713 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaagtggttttgcatcttttccttgcttaatctaagcatattattagagaagtcacaccatgctgaagctaatgagggcaaaatggtagtccatagattattttaaaataaccctttaaggttataaaagtttaa

SEQ ID NO: 290382 - DNA, 1760 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaagtggttttgcatcttttccttgcttaatctaagcatattattagagaagtcacaccatgctgaagctaatgagggcaaaatggtagtccatagattattttaaaataaccctttaaggttataaaagtttaa

SEQ ID NO: 290383 - DNA, 1757 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgattggtccagaaaagggcgtggtgcacctggcgacagcggccgtcctaaacgcggtgtgggacttgtgggccaagcaggagggaaagcctgtctggaagttacttgtggacatgagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaagtggttttgcatcttttccttgcttaatctaagcatattattagagaagtcacaccatgctgaagctaatgagggcaaaatggtagtccatagattattttaaaataaccctttaaggttataaaagtttaa

SEQ ID NO: 290384 - DNA, 1543 bp, Homo sapiens
cctgatcacctgggtttgacatcctagtaatttgtggctgggtgtgtgtgtgcagggccggatcaggagaacagctggactctccaggggaaacagcttagctacaggcacttccaattccgaagggccctggaaagtgcaaaatgttgacggcgctgtgttttcacaagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaagtggttttgcatcttttccttgcttaatctaagcatattattagagaagtcacaccatgctgaagctaatgagggcaaaatggtagtccatagattattttaaaataaccctttaaggttataaaagtttaa

SEQ ID NO: 290385 - DNA, 2173 bp, Homo sapiens
ctggagagggaggtgctgtccacgttgggaggagcgcagctggagcatgggccgggacaccgcagaaggagatctgcagagccctggtcaggaacggggctggtggtggcagctcagcagtgctcaccttctcctctgcagatacacagagccctcccgcacgcatgtgttcccctggacatcctttgccagtcttgagccttcacatggcttaacagcagggccgtttcctccttcagctataaatgtttttaaacattaggagttgcagttcaaaacttaggaaaataacaccaggctgccttctattttataggcactggtcccattaggaattggcattgccacaggagaacaggtgagtgacgcccccaacaggtggatgacgtccccttggggtcagtacacgctgaccagtgaccgaggacacagttgtgtgttaggctccatcacctgctgtactttgagttgggaaattttcatcatcttagaaactgggtcattttatcagagtctagagtcagatatagaaaaagtttgtggctatttctccaatttatatgactaaggtcgggtatctttttcaaagtgtctaattgaaattgaaaaggcagcaatttaaagttgctattgcaagggcagaaaatggtcttaagaaagccagctttcaaattgaataaacatgactgcgttcactttttgagcttataaatgaagcccgagtgcctgccaaaacctgctgcagtcagcccacgagcagagcagcgtgaggagctgattctcagttttcccggcaaaaggagcaatactgctctgccgtggttccgtgttgtcatctgtgccacctgctcatcactgtcaccgtatttcatcctgatgcttcatctcccacttatcagtcgctgtgacagtcattccctcataaatggcgagccagtgtgattttgacctgactcacactgttgcattagcagatttgtaaagaagtgagcacaaggtccctgcccacgctataaaagctcgcctcatgcccagcgagaacaaagaagaaatacagtctgggcttcctgacggccactgatgaataattattggcatagagtggctgcgttgccaggtttagagatcctgaaggccaaggctgactcttctgttggtgttattttcaattctatttccagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaagtggttttgcatcttttccttgcttaatctaagcatattattagagaagtcacaccatgctgaagctaatgagggcaaaatggtagtccatagattattttaaaataaccctttaaggttataaaagtttaa

SEQ ID NO: 290386 - DNA, 2486 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacaggtgagtgacgcccccaacaggtggatgacgtccccttggggtcagtacacgctgaccagtgaccgaggacacagttgtgtgttaggctccatcacctgctgtactttgagttgggaaattttcatcatcttagaaactgggtcattttatcagagtctagagtcagatatagaaaaagtttgtggctatttctccaatttatatgactaaggtcgggtatctttttcaaagtgtctaattgaaattgaaaaggcagcaatttaaagttgctattgcaagggcagaaaatggtcttaagaaagccagctttcaaattgaataaacatgactgcgttcactttttgagcttataaatgaagcccgagtgcctgccaaaacctgctgcagtcagcccacgagcagagcagcgtgaggagctgattctcagttttcccggcaaaaggagcaatactgctctgccgtggttccgtgttgtcatctgtgccacctgctcatcactgtcaccgtatttcatcctgatgcttcatctcccacttatcagtcgctgtgacagtcattccctcataaatggcgagccagtgtgattttgacctgactcacactgttgcattagcagatttgtaaagaagtgagcacaaggtccctgcccacgctataaaagctcgcctcatgcccagcgagaacaaagaagaaatacagtctgggcttcctgacggccactgatgaataattattggcatagagtggctgcgttgccaggtttagagatcctgaaggccaaggctgactcttctgttggtgttattttcaattctatttccagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaataggtcagtaatgtggcattaatactttctgtttcagtagggtccctcaatccaggccagagcttgtaaattctgccttcatgaccagaacacactaagaccttgtccgctggcatgtcctataactctcaggcggagttggttttgctttcacagagacccaccaatgaacggtcattttgcctcctaagatagggtctggtagctgactcactttattttttaagtacattgaaggtaaggcttgcagccacactactcccttaaccagctcctgttttcatcacgtgtattctgtacttctgtcccatctcctcttcccagtactggagtcttccatggtctagacacacatttatttcatcttatttctcagaacgccccaggtgggcttttaaattaggacaatctccttccagtcatctgcacacgtagggttttgc

SEQ ID NO: 290387 - DNA, 1289 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggtgagtagcattgttaatgttacaattgtttctgtaaatgaaatggatatcattgatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaagtggttttgcatcttttccttgcttaatctaagcatattattagagaagtcacaccatgctgaagctaatgagggcaaaatggtagtccatagattattttaaaataaccctttaaggttataaaagtttaa

SEQ ID NO: 290388 - DNA, 656 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaaggctgtgcacctagcgcctatagggatcctctagatcaaccc

SEQ ID NO: 290389 - DNA, 754 bp, Homo sapiens
cggccgcgggcttcgctccttgttggggattcggcggcggcggcggcgcgggcgcgcgcttcctagtgacgcaggcggcggggccgcgcacgcacggggctgggagggccggacacttatttggcgctcgcggaggaggaaggcggggccgtgaaataaggcccgacgggccccggggcgcgtgcgcggaccgacactgtcagctcctaacgccgcaggttcctcctggtccccgaggcccccggtcgggcgttgcctgccccgcgcgggcggccgggccgagggacgatggtcagtggacggacggcgccagggagcagtgcccacgcgcggcagggcggtaccttcaggcctccaggtacgggcgctcctcgcccggacgctgctgtgtgtgaatgggcgcgaggggactcccctgcggggcggacgcctgaacacgaggctgtggaggaggacgctgtagggtgcgcggactcacgcggaacatgccagaggctcagccaggcacggcgctcccagcgtggagggcgaggggcatccgggagcggccgggagggctcggtcacccctcaagctgtcaccccagtcccacaaccagcaccccgatcctatcgcagtcccacagccgacaccccgatcccacccctgcccaacagccggcacccaccccaatcccatagctaacaccccggtcccaccgctgtcccacggccggcaccccgatcccaccccagtcccgcagctggcaccccga

SEQ ID NO: 290390 - DNA, 939 bp, Homo sapiens
  misc_feature (920)..(920): n is a, c, g, or t
cggccgcgggcttcgctccttgttggggattcggcggcggcggcggcgcgggcgcgcgcttcctagtgacgcaggcggcggggccgcgcacgcacggggctgggagggccggacacttatttggcgctcgcggaggaggaaggcggggccgtgaaataaggcccgacgggccccggggcgcgtgcgcggaccgacactgtcagctcctaacgccgcaggttcctcctggtccccgaggcccccggtcgggcgttgcctgccccgcgcgggcggccgggccgagggacgatggtcagtggacggacggcgccagggagcagtgcccacgcgcggcagggcggtaccttcaggcctccagaggctggggctggctctgttggcctctgtgctgggtttcttcctctgcaccgcaggactggctctcctgacctctccaggtgtcatcgaacacccttgtgcttgctgtcacccgctgcctgtctgcaggatcccggattccgtatcaggggaccgaaattagtcggaaaataggaagcaggtgctcgcttggatggaaccctgaccctgtgctcacacttgtaggaggagggctctgcaggccgcctcccggaacgggaggttcccaagccactgcacttcggaggggctgtaattagagttgcacattcattcagttcccagtaaagtagaacgtgctccagccagtgaggaaaaggtgtttttaaaaattagattggccgagtgcggtggctcatgccttttacctcaacactttgggagacaaaggtgggaggatcacctgtggccaggagttcaagaccagcctgggcaacagagcctgtctctggggaagaataaaaaaaaaaattgagcctttaaaaaaaaaaagtcgacgcggccgcgaatttagtagtagtagnagtagtagtaggcggccgc

SEQ ID NO: 290391 - DNA, 284 bp, Homo sapiens
gaaaaggtgtttttaaaaattagattggccgagtgcggtggctcatgccttttacctcaacactttgggagacaaaggtgggaggatcacctgtggccaggagttcaagaccagcctgggcaacagagcctgtctctggggaagaataaaaaaaaaaattgagcctttgtcagtgctactattttattatctggtaaatatgagagggttcacgcggtctatgtgtgtcatttatctgagtttgcctatcgtcacgttttggaaataaatgtcaataaagtcga

SEQ ID NO: 290392 - DNA, 1720 bp, Homo sapiens
cgtcccccttccgccgcgtgggtgccatggcaacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290393 - DNA, 430 bp, Homo sapiens
ggaccagggtgaggacccgccggatgacagccaccctcaccgcggctggatgggggctctgcacccagccccaaggggtggccgtcctgagggggaagtgagaagggctcagagaggacctcgtgccgaattcggcacgagccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290394 - DNA, 936 bp, Homo sapiens
atttcttctccctcaggatcctataaatttctctgagattcacctctctgggttctctgctggaccacagagcctcatcctggctcacctctcccaaagcacaaagcattgcttctgtatatcaggaatcatttggttgccttgactgtatatcttggacctttgtcttggcttcctataataggatgaccagatttgtgttcagccattcaaaagaagccagcctgctgcagtactggatgacagagtaatgaggtctgtgggtttctatgctgtactcttctccctacacagcaagactgtttgcgttagtactgcttccagatattctgtggatggtctttgggcatgtggtgggaaacgttaccatgccagagaatttcagcaaatttaaccggctttgaaatgacttgttcttccagatttttatatacaaggaaaaccaaactaaagaagactgatgaaggtgcctctcttgtttgctctcttcacccgaccaattttcataccagtgaagctcctttggtcaaaatggtgtaactggatgcctcccaccctggaaaagctttgtagaaatactgatcttaaaatctcacacctggaggttagagactagcatacccttcacactgacttgcttttaaaagaacagctctaccaagaccaggtctgaaactcatgaaatgaacaaaaagagggcagtgacttgaaatgcagagacctaatgtgttcctctccatttccacttcagatttgctgaccatgaaagaatatcactgtttgctgcaattactgtgtcctgatttcccgctggagctcactcagaaagcagccaggtacgtctcctggactcttgaaaccaactcagctctctgtgggccactgcttcctagagaaacctcttttccctttcccatgatgtgagggagcttatga

SEQ ID NO: 290395 - DNA, 1994 bp, Homo sapiens
cgtcccccttccgccgcgtgggtgccatggcaacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggcttgtaagtgtcaagtgggaggatactgcccccttgtgggggccagacgggtcggacacggctgtgccccatctggggccaacaccacttgtctgtaacatcccacatctgccagggaagggtctgggggccagtggaggcctgaggtgtccctccctctgagtcctttgggggctgcagcccaggggtttaccctagtgttaagagtgggcatggaggccctgctctctgtacaggaggcctctcgctgccctccaggcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290396 - DNA, 1906 bp, Homo sapiens
ttttaaaagaaatctatttttaatggctttggctttatagcacgaagcaggcaccctctcgttaaaggcacacagtcctctcttctgccccacctcctgggtccttaaaatcgagtcctgagttccagaggggtcactgcaaggcagcagggaagggagagggtcacagtttcactctgtgagtatcagacacccagggccaaggcccagactggcctctgaagctacaggttaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290397 - DNA, 1738 bp, Homo sapiens
cgtcccccttccgccgcgtgggtgccatggcaacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290398 - DNA, 1803 bp, Homo sapiens
ttttaaaagaaatctatttttaatggctttggctttatagcacgaagcaggcaccctctcgttaaaggcacacagtcctctcttctgccccacctcctgggtccttaaaatcgagtcctgagttccagaggggtcactgcaaggcagcagggaagggagagggtcacagtttcactctgtgagtatcagacacccagggccaaggcccagactggcctctgaagctacaggttaacctgggttccggaagccggagagctggagctttgaagccaccccggtcaaaggatgctgagtccggagcgcctagccctaccggactacgagtatctggttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290399 - DNA, 1543 bp, Homo sapiens
gctggtaccggtcggagtggtgggatggatgctgagtccggagcgcctagccctaccggactacgagtatctggttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290400 - DNA, 1785 bp, Homo sapiens
cgtcccccttccgccgcgtgggtgccatggcaacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatagccctgcagaagctggacctcctgaactgtgtgacctacttcagtggtacctcaggttctacatgttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290401 - DNA, 1612 bp, Homo sapiens
tcctgccacaattcagaggcctccccagccatgtggaactctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290402 - DNA, 2077 bp, Homo sapiens
ttttaaaagaaatctatttttaatggctttggctttatagcacgaagcaggcaccctctcgttaaaggcacacagtcctctcttctgccccacctcctgggtccttaaaatcgagtcctgagttccagaggggtcactgcaaggcagcagggaagggagagggtcacagtttcactctgtgagtatcagacacccagggccaaggcccagactggcctctgaagctacaggttaacctgggttccggaagccggagagctggagctttgaagccaccccggtcaaaggatgctgagtccggagcgcctagccctaccggactacgagtatctggttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggcttgtaagtgtcaagtgggaggatactgcccccttgtgggggccagacgggtcggacacggctgtgccccatctggggccaacaccacttgtctgtaacatcccacatctgccagggaagggtctgggggccagtggaggcctgaggtgtccctccctctgagtcctttgggggctgcagcccaggggtttaccctagtgttaagagtgggcatggaggccctgctctctgtacaggaggcctctcgctgccctccaggcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290403 - DNA, 1589 bp, Homo sapiens
cgtcccccttccgccgcgtgggtgccatggcaacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaataatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290404 - DNA, 1672 bp, Homo sapiens
ttttaaaagaaatctatttttaatggctttggctttatagcacgaagcaggcaccctctcgttaaaggcacacagtcctctcttctgccccacctcctgggtccttaaaatcgagtcctgagttccagaggggtcactgcaaggcagcagggaagggagagggtcacagtttcactctgtgagtatcagacacccagggccaaggcccagactggcctctgaagctacaggttaacctgggttccggaagccggagagctggagctttgaagccaccccggtcaaaggatgctgagtccggagcgcctagccctaccggactacgagtatctggatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290405 - DNA, 2089 bp, Homo sapiens
atttcttctccctcaggatcctataaatttctctgagattcacctctctgggttctctgctggaccacagagcctcatcctggctcacctctcccaaagcacaaagcattgcttctgtatatcaggaatcatttggttgccttgactgtatatcttggacctttgtcttggcttcctataataggatgaccagatttgtgttcagccattcaaaagaagccagcctgctgcagtactggatgacagagtaatgaggtctgtgggtttctatgctgtactcttctccctacacagcaagactgtttgcgttagtactgcttccagatattctgtggatggtctttgggcatgtggtgggaaacgttaccatgccagagaatttcagcaaatttaaccggctttgaaatgacttgttcttccagatttttatatacaaggaaaaccaaactaaagaagactgatgaaggtgcctctcttgtttgctctcttcacccgaccaattttcataccagtgaagctcctttggtcaaaatggtgtaactggatgcctcccaccctggaaaagctttgtagaaatactgatcttaaaatctcacacctggaggttagagactagcatacccttcacactgacttgcttttaaaagaacagctctaccaagaccaggtctgaaactcatgaaatgaacaaaaagagggcagtgacttgaaatgcagagacctaatgtgttcctctccatttccacttcagatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290406 - DNA, 1539 bp, Homo sapiens
gtgccttttgcctcctgccacaattcagaggcctccccagccatgtggaactttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290407 - DNA, 1527 bp, Homo sapiens
agggacacaaaattaggtaatgtctgacctttgggcttagcctggaccatatccttttcagcccagtacctgaggcctcaagaaggaactcaactcccagcaccaggtcacaaccaccacctggtgttggaaggggatcaccacactccttggctgtggtgtctgccccaggcagggaaagtaggcagtgggattcaataaatgtatcaagcaacagcgagcaccttcctgctccgtgactgttcttggcccctctagcagtcctcagatctttagatcggccctcgcagggtcagcagaacaggcagccgtgaaggtgaggggcatggaggaatctgttgcctggctgaagggccctcagattaactactgtgcccccaatgatctcctaggagctttgcctgacaagggggatctgatgcacgacccagcaatggatgaagagctggaacggcttgtaagtgtcaagtgggaggatactgcccccttgtgggggccagacgggtcggacacggctgtgccccatctggggccaacaccacttgtctgtaacatcccacatctgccagggaagggtctgggggccagtggaggcctgaggtgtccctccctctgagtcctttgggggctgcagcccaggggtttaccctagtgttaagagtgggcatggaggccctgctctctgtacaggaggcctctcgctgccctccaggcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290408 - DNA, 1186 bp, Homo sapiens
cgtcccccttccgccgcgtgggtgccatggcaacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaaaaaaaagtctaaa

SEQ ID NO: 290409 - DNA, 1213 bp, Homo sapiens
cgtcccccttccgccgcgtgggtgccatggcaacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctggtggtgaggtcgaagctgcaccggacctcacggcagcacagagccaaggagccaggggcctttggctttcagagaagagagaagcaggaggccctggagagagtgtcctcagcttcggtaccgacgccctaccattaccggtgggagcccagagagtgaggccaggggccggcactgggcagggaggcaggatccagaggacactgcttcactcagaccaacagggagccaggccctgcaggggctttattttgacaccactttgtttcaatacaaacagtccagaaag

SEQ ID NO: 290410 - DNA, 1291 bp, Homo sapiens
cgtcccccttccgccgcgtgggtgccatggcaacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggtaagtcagagctaagcagccgtcagcctctcctgccgcacaacacagggagcagctggcctctgttagcaacacggctccagaggggaaggggcatcaccatctctgccttgacttcccagggccggactcaatcccagggagcaggaatatggcgacaaaacatggctcttacacattcccatggtaggggacagccctccctgcctgcagccctgccccaacatgaaaccacctccccatagcagaagcgcccagcccctcctcagagaaccccagctctgctttggggagcagcctgcaggtcgggcagacacaggactatttactcagtgacgctagagattatatatcaaagagacctgaatcccatttataaacaaggcaaaggtgtgtctgcggagaccttttttccaagctgaaaaaaaaaat

SEQ ID NO: 290411 - DNA, 807 bp, Homo sapiens
cgtcccccttccgccgcgtgggtgccatggcaacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctaggacacagacagcgtatcataggccttcagtcagtcagagactacgtcgtactgt

SEQ ID NO: 290412 - DNA, 1244 bp, Homo sapiens
cgtcccccttccgccgcgtgggtgccatggcaacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcaggtgagtgttccggggctccatctggctccgcacaggaccctgtctccctgtcctgccctgctgccctgcccatctgtgtgcctggcacacacgtttctcttccccacttcctttgggggtgtgcttcactgcgggtcgctaacaggatgtctagtgttcagtggtggtcacaagattcagtctgcagagccgacttcctcagcctcctgaagacactgaacaccgcagtgttttcagtcagcaacgcaacaaatcagtttaagtgataatgacaataacaacatccatagcatccacagcattcactgcttactgaaaacttactatgtcccaggcacagcactgactttaatcttgacaacagccttgagagagagtcctttcagagacaagctcacagaagtagtagccagtcatgcagctcataagtggtggagaccagacctgaaggctgactccaaagccagcgttcccaacctcgctgctattttactgccttcaagggtctctcccttggcaactgatcgtgcgtttgggtgcacattctcctccaccccacagctttaaaaaagcatacaccagtcctttgtcacactcccactctgctccccaattcacacagctgcacccttaagtctctctggaatcagatggaataaatatagacaaataaatataaatatacaccagc

SEQ ID NO: 290413 - DNA, 910 bp, Homo sapiens
cgtcccccttccgccgcgtgggtgccatggcaacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcaggcacagcactgactttaatcttgacaacagccttgagagagagtcctttcagagacaagctcacagaagtagtagccagtcatgcagctcataagtggtggagaccagacctgaaggctgactccaaagccagcgttcccaacctcgctgctattttactgccttcaagggtctctcccttggcaactgatcgtgcgtttgggtgcacattctcctccaccccacagctttaaaaaagcatacaccagtcctttgtcacactcccactctgctccccaattcacacagctgcacccttaagtctctctggaatcagatggaataaatatagacaaataaatataaatatacaccagc

SEQ ID NO: 290414 - DNA, 961 bp, Homo sapiens
ttttaaaagaaatctatttttaatggctttggctttatagcacgaagcaggcaccctctcgttaaaggcacacagtcctctcttctgccccacctcctgggtccttaaaatcgagtcctgagttccagaggggtcactgcaaggcagcagggaagggagagggtcacagtttcactctgtgagtatcagacacccagggccaaggcccagactggcctctgaagctacaggttaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggtacgtctcctggactcttgaaaccaactcagctctctgtgggccactgcttcctagagaaacctggagtgtatacaaatgaaaaaaaggagcatttagggaagaaactggcagtgggagaggggtctatttgggatgtgccccaaaacataatacattctgcatttccaaagggaagcgaaatgatcctttgtggtttctgtggggagcctcagggtctgaagatagagttggagggtggtgagatgaagaggcagaaaaagcccagacccctccaatacccccacacacacacaccctagaggata

SEQ ID NO: 290415 - DNA, 968 bp, Homo sapiens
ttttaaaagaaatctatttttaatggctttggctttatagcacgaagcaggcaccctctcgttaaaggcacacagtcctctcttctgccccacctcctgggtccttaaaatcgagtcctgagttccagaggggtcactgcaaggcagcagggaagggagagggtcacagtttcactctgtgagtatcagacacccagggccaaggcccagactggcctctgaagctacaggttaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcggtaagtcttcccaaattctttttccttccttccttccttccttcctttcttccttccttccttcctctctctctctttctttctctctctcttttcctctctttctctttcaaactttttcttttgttcctataaatattgtttgaatgcatgctattcaaggcatttagaatacctcacttttgaggagttgtctggtttatgtccaagatattactattaccactaccatcactaatggtacctattaagagccaagtgtagctctttacatgtagtaactcatttatctttacaagggctctctgtggtagataccataatccccattttgtaactaatgaaactgaggatcagagaggttaagtaacttggcaaggttacatagtaaattctgggc

SEQ ID NO: 290416 - DNA, 945 bp, Homo sapiens
ttttaaaagaaatctatttttaatggctttggctttatagcacgaagcaggcaccctctcgttaaaggcacacagtcctctcttctgccccacctcctgggtccttaaaatcgagtcctgagttccagaggggtcactgcaaggcagcagggaagggagagggtcacagtttcactctgtgagtatcagacacccagggccaaggcccagactggcctctgaagctacaggttaacctgggttccggaagccggagagctggagctttgaagccaccccggtcaaaggatgctgagtccggagcgcctagccctaccggactacgagtatctggttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggggccaaaaggaaaaaaccccccaaaaacaaacaaagggttggactttcggttgggccccggaaaccggtttcaggttcccaagaggtggcgggacaaaggacaaaatcccggaggccaatatccggaaacccccatggcccccttttggcggcgccccgggggtggccgccgtgtgtctcaaaccggacccatggggcaacgacgggcccggattggcgccaacgcgggccggagatccggaccactggcattattcatttac

SEQ ID NO: 290417 - DNA, 1051 bp, Homo sapiens
ttttaaaagaaatctatttttaatggctttggctttatagcacgaagcaggcaccctctcgttaaaggcacacagtcctctcttctgccccacctcctgggtccttaaaatcgagtcctgagttccagaggggtcactgcaaggcagcagggaagggagagggtcacagtttcactctgtgagtatcagacacccagggccaaggcccagactggcctctgaagctacaggttaacctgggttccggaagccggagagctggagctttgaagccaccccggtcaaaggatgctgagtccggagcgcctagccctaccggactacgagtatctggttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggcttgtgggccaggtccagggctggtcaactcgggtcacaagcagtccagaagcatgttgctgctttcggacctccggggtggtctcctggagaccttttcattatcgcggaaagggttgcgaagatggctggtccctgaaagaagacggttgggatttgggtcaggctgcccaggcgtgctgtttcaccacgtgggggccccccttctcacttggtcgccttgcaaggtaagcccgacagggt

SEQ ID NO: 290418 - DNA, 814 bp, Homo sapiens
cgtcccccttccgccgcgtgggtgccatggcaacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatagtaagtacatgaatgttgtactaatacagtgaacccagaggaggcgcttggaagcaggcaggatacttgaggaacagagcaggacaatgctgattaggtagtggcagtgaatgtttagtttggtaggttggttgtgggccgcccaaacatgttttggagcatgcctttggtgcagctagtttgtccagtgatgtctcatgaatagttttgattacagtagcttaacaactgcttgtttgatctattagatctatttctgtaggtttctcttttaactttctcctttattcaaaatattcactttgatttcctttcgctgatgttcatctagcctgttttttttcatggctggcttttctcatggaatctaggctaatgttcctctgcagtttttctttctacaggatgctgtgccaatcacttaatgatttaagtgtatttctaatcagcaagtgaagagacaaccacagaatgggagaaagtatttggcaagctggccaatctgacaggggattaatgacagaatatataaggaggtcaaatatttctatagggaaaaatca

SEQ ID NO: 290419 - DNA, 847 bp, Homo sapiens
gctggtaccggtcggagtggtgggatggatgctgagtccggagcgcctagccctaccggactacgagtatctgggcatgcttgaaacaataacacttttgaatgtaagatatatgaaaggccacacgtcttcggctttgcttgtcaaatggagaggctgccagaaccggtcggctccatggttctcatgccccaaagtcctgcaaattgacacctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcggtaagtcttcccaaattctttttccttccttccttccttccttcctttcttccttccttccttcctctctctctctttctttctctctctcttttcctctctttctctttcaaactttttcttttgttcctataaatattgtttgaatgcatgctattcaaggcatttagaatacctcacttttgaggagttgtctggtttatgtccaagatattactattaccactaccatcactaatggtacctattaagagccaagtgtagctctttacatgtagtaactcatttatctttacaagggctctctgtggtagataccataatccccattttgtaactaatgaaactgaggatcagagaggttaagtaacttggcaaggttacatagtaaattctgggc

SEQ ID NO: 290420 - DNA, 740 bp, Homo sapiens
ggtaagaagtgcctttcacctgccgccgtgattctggggcctccccggccatgtggaattgctgagggtgatggtaggaaaagatgtcccagagttgggctcattaatatccacggagagggtgtggccctgaagagatagagaacatagtggtggcagtgacctgcaaaagccagaggacacggttaccatggcaaccccagaggagcagccgagggggcttgacctgcctgcagttgtgggtgacataggaggatgccagctttgagtggagcctccacaggaaaggacactgcagcagatccaggccatggcgcagtcaccatccttcagaccccctggtgctgaaagtgccagtggtgggggtagaaggtcctggattctaaaggagggtacccttaaaaggggacaaatgagtgcccattgaactacacattacagctgccacaggggaattggacagtatgtgtccagagaccagcgggtgagaagaggagtcccctcctctccaggcacagatttactcctccgggcgggcccctcgctccttcccgcagaggccttttccctcccgaccccgcactcacctgcccaggtctggatcaggggcacggctcccgagaacagcaggaggagggttcgggactccatgacccgcaaccttggcgtctggggagaatctgagtcccggtgggccggcgaggactttagaaccaggaaccgcggcgacactgattggc

SEQ ID NO: 290421 - DNA, 1054 bp, Homo sapiens
ggtaagaagtgcctttcacctgccgccgtgattctggggcctccccggccatgtggaattgctgagggtgatggtaggaaaagatgtcccagagttgggctcattaatatccacggagagggtgtggccctgaagagatagagaacatagtggtggcagtgacctgcaaaagccagaggacacggttaccatggcaaccccagaggagcagccgagggggcttgacctgcctgcagttgtgggtgacataggaggatgccagctttgagtggagcctccacaggaaaggacactgcagcagatccaggccatggcgcagtcaccatccttcagaccccctggtgctgaaagtgccagtggtggggtaagatttggggtggagctgaaccaagcaccagtaggagagtcacagtggagggcctgggattctggagtaaggccatgtcatccacagcacagaaatatgccccatccaaagcagagaaatatgttggaagcaacttttggcatgttactgtaggccctgataagatagaatgcttgaccatgggacacaaaacaaccatgtgattccaagtgcccctacgaattagcatctgtgtaactcatgaagtcatacattggacatgcccaacagcatccatcatgagatggaaaagtttcttgtgagttgagcctgaatcccatgttaacatccccagaaaacacccaaacctgaaatggccctgaacaaccaagcagaagcactgaaattagccagccttccccatgggtcagcccaggccgggtaggatgggtacataaatggagcaaacacagtggcagggatgaggctacctatgggtccaacagtactgactccctcctaccaaggtagatccagacactgccacctctaaatgtcctactcatcagcatttgaacccaatgatcttccctggtagggctctatttctttaggtgaccaaccagaccctaagtgaggagttgactacattgcactccttccatcctggaagggccagaggttcatcttcacagggataggcaccta

SEQ ID NO: 290422 - DNA, 6885 bp, Homo sapiens
  misc_feature (347)..(347): n is a, c, g, or t
  misc_feature (402)..(402): n is a, c, g, or t
  misc_feature (457)..(457): n is a, c, g, or t
cgctgcaaatgccagggcagtgaagccgaacagaaaaccccatcgctttaaaaaggcagctgtccgccctccccctttcccctcgccaggcgaggcccctcaagtccgggatccgcgagctgcgcggaggatctcgccaaacccgagcaccgtgcggcgtcttttaagagctcgaacaacgggaatccagcaaaaaacaagccggccccagaaggcagcctccctcctctctccgcgcacgggctacaatcgcccccagtccccaaactgtcccagtagaggccgcgcggagagagcagagccgagggacccagcgcaaggcgggagccaagcgcggctgctttaanaacgcggagagcgcgcgcccgccgccagctggcccgggctgcgcgcccccgccgncaccgcgcgccccctgttcgctcgctccttcgctcgccggctttaaagtctctgncaggatccatgctcacatgttacttcctgtatggaggcatggccagtttccagccccgcgctcttcgttccttcccagcctgcgccggagccacaactttcaggagcatggactgaaggcgccctcgccccagcgcccctctgagatcctttgtgttttcctccgtttcctccggccgtttctattttggggggctctccgctccccctgcctctcccctccccttcccctctcgcaaacatgcctccttccttcccggggccctggaaggagctgcctgcctgaagcccggagacgccgcgccgcgctcagccccgccgccgcccgccggctctcgggctgtgctgcgctgccgactcaagttggggatcctcggctgctcgccgccgccgcccgcggtccctgcctgccccaggcccggggcatcgccgccggccgccgactccgcgccctgcccgatcggctctctcctttttaaacggaaagcagcctttctccgccgagaggatcgtccccagcgtggctctgcgttcccggtcactttttgagattttccggggggcgctcggcggcttcccggattccaaggggactcgggccgccgagcgcggggggcccgtggagcgggcgagccggggaagcgccccggcttagcggaggctcgcacggaggcaagaacttattcaacaagtttacctccctgctttcctcttttcgatgtgcgttttcggacatgcggaggttactggaaccgtgttggtggattttgttcctgaaaatcaccagttccgtgctccattatgtcgtgtgcttccccgcgttgacagaaggctacgttggggccctgcacgagaatagacacggcagcgcagtgcagatccgcaggcgcaaggcttcaggcgacccgtactgggcctactctggtgcctatggtcctgagcactgggtcacgtctagtgtcagctgtgggggccgtcaccagtctcctattgacattttagaccagtatgcgcgtgttggggaagaataccaggaactgcaactcgatggcttcgacaatgagtcttctaacaaaacctggatgaaaaacacagggaaaacagtcgccatccttctgaaagacgactattttgtcagtggagctggtctacctggcagattcaaagctgagaaggtggaatttcactggggccacagcaatggctcagcgggctctgaacacagcatcaatggcaggaggtttcctgttgagatgcagattttcttttacaatccagatgactttgacagctttcaaaccgcaatttctgagaacagaataatcggagccatggccatattttttcaagtcagtccgagggacaattctgcactggatcctattatccacgggttgaagggtgtcgtacatcatgagaaggagacctttctggatcctttcgtcctccgggacctcctgcctgcatccctgggcagctattatcggtacacaggttccttgaccacaccaccgtgtagcgaaatagtggagtggatagtcttccggagacccgtccccatctcttaccatcagcttgaggctttttattccatcttcaccacggagcagcaagaccatgtcaagtcggtggagtatctgagaaataactttcgaccacagcagcgtctgcatgacagggtggtgtccaagtccgccgtccgtgactcctggaaccacgacatgacagacttcttagaaaacccactggggacagaagcctctaaagtttgcagctctccacccatccacatgaaggtgcagcctctgaaccagacggcactgcaggtgtcctggagccagccggagactatctaccacccacccatcatgaactacatgatctcctacagctggaccaagaatgaggacgagaaggagaagacgtttacaaaggacagcgacaaagacttgaaagccaccattagccatgtctcacccgatagcctttacctgttccgagtccaggccgtgtgtcggaacgacatgcgcagcgactttagccagacgatgctgtttcaagctaataccactcgaatattccaagggaccagaatagtgaaaacaggagtgcccacagcgtctcctgcctcttcagccgacatggcccccatcagctcggggtcttctacctggacgtcctctggcatcccattctcatttgtttccatggcaactgggatgggcccctcctccagtggcagccaggccacagtggcctcggtggtcaccagcacgctgctcgccggcctggggttcggcggtggtggcatctcctctttccccagcactgtgtggcccacgcgcctcccgacggccgcctcagccagcaagcaggcggctaggccagtcctagccaccacagaggccttggcttctccagggcccgatggtgattcgtcaccaaccaaggacggcgagggcaccgaggaaggagagaaggatgagaaaagcgagagtgaggatggggagcgggagcacgaggaggatggagagaaggactccgaaaagaaggagaagagtggggtgacccacgctgccgaggagcggaatcagacggagcccagccccacaccctcgtctcctaacaggactgccgagggagggcatcagactatacctgggcatgagcaggatcacactgccgtccccacagaccagacgggcggaaggagggatgccggcccaggcctggaccccgacatggtcacctccacccaagtgccccccaccgccacagaggagcagtatgcagggagtgatcccaagaggcccgaaatgccatctaaaaagcctatgtcccgcggggaccgattttctgaagacagcagatttatcactgttaatccagcggaaaaaaacacctctggaatgataagccgccctgctccagggaggatggagtggatcatccctctgattgtggtatcagccttgaccttcgtgtgcctcatccttctcattgctgtgctcgtttactggagagggtgtaacaaaataaagtccaagggctttcccagacgtttccgtgaagtgccttcttctggggagagaggagagaaggggagcagaaaatgttttcagactgctcatttctatgtggaagacagcagttcacctcgagtggtccctaatgaaagtattcctattattcctattccggatgacatggaagccattcctgtcaaacagtttgtcaaacacatcggtgagctctattctaataaccagcatgggttctctgaggattttgaggaagtccagcgctgtactgctgatatgaacatcactgcagagcattccaatcatccagaaaacaagcacaaaaacagatacatcaacattttagcatatgatcacagtagggtgaagttaagacctttaccaggaaaagactctaagcacagcgactacattaatgcaaactatgttgatggttacaacaaagcaaaagcctacattgccacccaaggacctttgaagtctacatttgaagatttctggaggatgatttgggaacaaaacactggaatcattgtgatgattacgaaccttgtggaaaaaggaagacgaaaatgtgatcagtattggccaacagagaacagtgaggaatatggaaacattattgtcacgctgaagagcacaaaaatacatgcctgctacactgttcgtcgtttttcaatcagaaatacaaaagtgaaaaagggtcagaagggaaatcccaagggtcgtcagaatgaaagggtagtgatccagtatcactatacacagtggcctgacatgggagttcccgagtatgcccttccagtactgactttcgtgaggagatcctcagcagctcggatgccagaaacgggccctgtgttggtgcactgcagtgctggtgtgggcagaacaggcacctatattgtaatagacagcatgctgcaacagataaaagacaaaagcacagttaacgtcctgggattcctgaagcatatcaggacacagcgtaactacctcgtccagactgaggagcagtacattttcatccatgatgccttgttggaagccattcttggaaaggagactgaagtatcttcaaatcagctgcacagctatgttaacagcatccttataccaggagtaggaggaaagacacgactggaaaagcaattcaagctggtcacacagtgtaatgcaaaatatgtggaatgtttcagtgctcagaaagagtgtaacaaagaaaagaacagaaactcttcagttgtgccatctgagcgtgctcgagtgggtcttgcaccattgcctggaatgaaaggaacagattacattaatgcttcttatatcatgggctattataggagcaatgaatttattataactcagcatcctctgccacatactacgaaagatttctggcgaatgatttgggatcataacgcacagatcattgtcatgctgccagacaaccagagcttggcagaagatgagtttgtgtactggccaagtcgagaagaatccatgaactgtgaggcctttaccgtcacccttatcagcaaagacagactgtgcctctctaatgaagaacaaattatcatccatgactttatccttgaagctacacaggatgactatgtcttagaagttcggcactttcagtgtcccaaatggcctaacccagatgcccccataagtagtacctttgaacttatcaacgtcatcaaggaagaggccttaacaagggatggtcccaccattgttcatgatgagtatggagcagtttcagcaggaatgttatgtgcccttaccaccctgtcccagcaactggagaatgaaaatgctgtggatgttttccaggttgcaaaaatgatcaatcttatgaggcctggagtattcacagacattgaacaataccagttcatctataaagcaatgcttagcttggtcagcactaaagaaaatggaaatggtcccatgacagtagacaaaaatggtgctgttcttattgcagatgaatcagaccctgctgagagcatggagtccctagtgtgactggaatcctgaaagggcacttaatttgtaaacttctgaagactgagaacttttttgaggccttttttgccagactctaggttatacaataacccagttacttttttacactgataaaagttttgatatttattttttgccattttatgtcttaatggtatcctactgagcatttgcacctctgttcatttcacacagtgaaacgcaattttacctagtttgcactatatgatcagtgttactgcctataatcttatacaacagcaaaccctgatgtgacattccatgacgacatacatgctacttttttttagttcaatacagtgaaggtctttgttatgacagtgaatattgcttttattattattattgctgaagtggttgcattctactagcaggcaatgctgtacttttcttcagtcctcctctcctttttattttaggcactgttcaatactgtatgccttctgtattttaatggagtggatagcattgttttcttttacagactagcaggctactgggacctaaaaaggtctgttaatgtcatggccttgaaacagttccatttatgctggttaagagatcccttaagaagttagaaggcttaagaactgcttcatgtgaacatcccttattagttacaaagttatattcacagttttttaaaaatgtgtcaaaataaaggataactctgtattacagctttcacagtagctatgtggacaatgtgttatttccattttgactctctaaaatagctacatcctaaaatcagggctatctttaacaatagcaagatagcaatattatatacaactcagttatgagaccctttagttattctccattaatgcttcttagtttgtaataccatacctcacagtaggtagaagaatgaaaacttctgcaggtgtgtaattttgaaactagtcctctaaaaattccctattactcctatagcaatctaataaaaactacctacatagttactgttttctttccttctttgccaaatgttttataataaatctcttaattacatacatttttctacttaagattaaattggaaatactgtattagcaaaagtcttgggactatctaaactcccacacatagataaatctgatttggagagagaaatttaaaatatttaattaaaggtgatacccacattttcaagtttttaaaagagggagatggctttgtatgcttttgtgtagtttagaacagatacacattagtaaaagataccaataatcattagagctcaaggaagttattaggtgcagcctctggagccatactcacgctgcagtgcataatgggaaaattaggagcattaataagaaat

SEQ ID NO: 290423 - DNA, 6244 bp, Homo sapiens
  misc_feature (347)..(347): n is a, c, g, or t
  misc_feature (402)..(402): n is a, c, g, or t
  misc_feature (457)..(457): n is a, c, g, or t
cgctgcaaatgccagggcagtgaagccgaacagaaaaccccatcgctttaaaaaggcagctgtccgccctccccctttcccctcgccaggcgaggcccctcaagtccgggatccgcgagctgcgcggaggatctcgccaaacccgagcaccgtgcggcgtcttttaagagctcgaacaacgggaatccagcaaaaaacaagccggccccagaaggcagcctccctcctctctccgcgcacgggctacaatcgcccccagtccccaaactgtcccagtagaggccgcgcggagagagcagagccgagggacccagcgcaaggcgggagccaagcgcggctgctttaanaacgcggagagcgcgcgcccgccgccagctggcccgggctgcgcgcccccgccgncaccgcgcgccccctgttcgctcgctccttcgctcgccggctttaaagtctctgncaggatccatgctcacatgttacttcctgtatggaggcatggccagtttccagccccgcgctcttcgttccttcccagcctgcgccggagccacaactttcaggagcatggactgaaggcgccctcgccccagcgcccctctgagatcctttgtgttttcctccgtttcctccggccgtttctattttggggggctctccgctccccctgcctctcccctccccttcccctctcgcaaacatgcctccttccttcccggggccctggaaggagctgcctgcctgaagcccggagacgccgcgccgcgctcagccccgccgccgcccgccggctctcgggctgtgctgcgctgccgactcaagttggggatcctcggctgctcgccgccgccgcccgcggtccctgcctgccccaggcccggggcatcgccgccggccgccgactccgcgccctgcccgatcggctctctcctttttaaacggaaagcagcctttctccgccgagaggatcgtccccagcgtggctctgcgttcccggtcactttttgagattttccggggggcgctcggcggcttcccggattccaaggggactcgggccgccgagcgcggggggcccgtggagcgggcgagccggggaagcgccccggcttagcggaggctcgcacggaggcaagaacttattcaacaagtttacctccctgctttcctcttttcgatgtgcgttttcggacatgcggaggttactggaaccgtgttggtggattttgttcctgaaaatcaccagttccgtgctccattatgtcgtgtgcttccccgcgttgacagaaggctacgttggggccctgcacgagaatagacacggcagcgcagtgcagatccgcaggcgcaaggcttcaggcgacccgtactgggcctactctggtgcctatggtcctgagcactgggtcacgtctagtgtcagctgtgggggccgtcaccagtctcctattgacattttagaccagtatgcgcgtgttggggaagaataccaggaactgcaactcgatggcttcgacaatgagtcttctaacaaaacctggatgaaaaacacagggaaaacagtcgccatccttctgaaagacgactattttgtcagtggagctggtctacctggcagattcaaagctgagaaggtggaatttcactggggccacagcaatggctcagcgggctctgaacacagcatcaatggcaggaggtttcctgttgagatgcagattttcttttacaatccagatgactttgacagctttcaaaccgcaatttctgagaacagaataatcggagccatggccatattttttcaagtcagtccgagggacaattctgcactggatcctattatccacgggttgaagggtgtcgtacatcatgagaaggagacctttctggatcctttcgtcctccgggacctcctgcctgcatccctgggcagctattatcggtacacaggttccttgaccacaccaccgtgtagcgaaatagtggagtggatagtcttccggagacccgtccccatctcttaccatcagcttgaggctttttattccatcttcaccacggagcagcaagaccatgtcaagtcggtggagtatctgagaaataactttcgaccacagcagcgtctgcatgacagggtggtgtccaagtccgccgtccgtgactcctggaaccacgacatgacagacttcttagaaaacccactggggacagaagcctctaaagtttgcagctctccacccatccacatgaaggtgcagcctctgaaccagacggcactgcaggtgtcctggagccagccggagactatctaccacccacccatcatgaactacatgatctcctacagctggaccaagaatgaggacgagaaggagaagacgtttacaaaggacagcgacaaagacttgaaagccaccattagccatgtctcacccgatagcctttacctgttccgagtccaggccgtgtgtcggaacgacatgcgcagcgactttagccagacgatgctgtttcaagctaataccactcgaatattccaagggaccagaatagtgaaaacaggagtgcccacagcgtctcctgcctcttcagccgacatggcccccatcagctcggggtcttctacctggacgtcctctggcatcccattctcatttgtttccatggcaactgggatgggcccctcctccagtggcagccaggccacagtggcctcggtggtcaccagcacgctgctcgccggcctggggttcggcggtggtggcatctcctctttccccagcactgtgtggcccacgcgcctcccgacggccgcctcagccagcaagcaggcggctaggccagtcctagccaccacagaggccttggcttctccagggcccgatggtgattcgtcaccaaccaaggacggcgagggcaccgaggaaggagagaaggatgagaaaagcgagagtgaggatggggagcgggagcacgaggaggatggagagaaggactccgaaaagaaggagaagagtggggtgacccacgctgccgaggagcggaatcagacggagcccagccccacaccctcgtctcctaacaggactgccgagggagggcatcagactatacctgggcatgagcaggatcacactgccgtccccacagaccagacgggcggaaggagggatgccggcccaggcctggaccccgacatggtcacctccacccaagtgccccccaccgccacagaggagcagtatgcagggagtgatcccaagaggcccgaaatgccatctaaaaagcctatgtcccgcggggaccgattttctgaagacagcagatttatcactgttaatccagcggaaaaaaacacctctggaatgataagccgccctgctccagggaggatggagtggatcatccctctgattgtggtatcagccttgaccttcgtgtgcctcatccttctcattgctgtgctcgtttactggagagggtgtaacaaaataaagtccaagggctttcccagacgtttccgtgaagtgccttcttctggggagagaggagagaaggggagcagaaaatgttttcagactgctcatttctatgtggaagacagcagttcacctcgagtggtccctaatgaaagtattcctattattcctattccggatgacatggaagccattcctgtcaaacagtttgtcaaacacatcggtgagctctattctaataaccagcatgggttctctgaggattttgaggaagtccagcgctgtactgctgatatgaacatcactgcagagcattccaatcatccagaaaacaagcacaaaaacagatacatcaacattttagcatatgatcacagtagggtgaagttaagacctttaccaggaaaagactctaagcacagcgactacattaatgcaaactatgttgatggttacaacaaagcaaaagcctacattgccacccaaggacctttgaagtctacatttgaagatttctggaggatgatttgggaacaaaacactggaatcattgtgatgattacgaaccttgtggaaaaaggaagacgaaaatgtgatcagtattggccaacagagaacagtgaggaatatggaaacattattgtcacgctgaagagcacaaaaatacatgcctgctacactgttcgtcgtttttcaatcagaaatacaaaagtgaaaaagggtcagaagggaaatcccaagggtcgtcagaatgaaagggtagtgatccagtatcactatacacagtggcctgacatgggagttcccgagtatgcccttccagtactgactttcgtgaggagatcctcagcagctcggatgccagaaacgggccctgtgttggtgcactgcagtgctggtgtgggcagaacaggcacctatattgtaatagacagcatgctgcaacagataaaagacaaaagcacagttaacgtcctgggattcctgaagcatatcaggacacagcgtaactacctcgtccagactgaggagcagtacattttcatccatgatgccttgttggaagccattcttggaaaggagactgaagtatcttcaaatcagctgcacagctatgttaacagcatccttataccaggagtaggaggaaagacacgactggaaaagcaattcaagctggtcacacagtgtaatgcaaaatatgtggaatgtttcagtgctcagaaagagtgtaacaaagaaaagaacagaaactcttcagttgtgccatctgagcgtgctcgagtgggtcttgcaccattgcctggaatgaaaggaacagattacattaatgcttcttatatcatgggctattataggagcaatgaatttattataactcagcatcctctgccacatactacgaaagatttctggcgaatgatttgggatcataacgcacagatcattgtcatgctgccagacaaccagagcttggcagaagatgagtttgtgtactggccaagtcgagaagaatccatgaactgtgaggcctttaccgtcacccttatcagcaaagacagactgtgcctctctaatgaagaacaaattatcatccatgactttatccttgaagctacacaggatgactatgtcttagaagttcggcactttcagtgtcccaaatggcctaacccagatgcccccataagtagtacctttgaacttatcaacgtcatcaaggaagaggccttaacaagggatggtcccaccattgttcatgatgagtatggagcagtttcagcaggaatgttatgtgcccttaccaccctgtcccagcaactggagaatgaaaatgctgtggatgttttccaggttgcaaaaatgatcaatcttatgaggcctggagtattcacagacattgaacaataccagttcatctataaagcaatgcttagcttggtcagcactaaagaaaatggaaatggtcccatgacagtagacaaaaatggtgctgttcttattgcagatgaatcagaccctgctgagagcatggagtccctagtgtgactggaatcctgaaagggcacttaatttgtaaacttctgaagactgagaacttttttgaggccttttttgccagactctaggttatacaataacccagttacttttttacactgataaaagttttgatatttattttttgccattttatgtcttaatggtatcctactgagcatttgcacctctgttcatttcacacagtgaaacgcaattttacctagtttgcactatatgatcagtgttactgcctataatcttatacaacagcaaaccctgatgtgacattccatgacgacatacatgctacttttttttagttcaatacagtgaaggtctttgttatgacagtgaatattgcttttattattattattgctgaagtggttgcattctactagcaggcaatgctgtacttttcttcagtcctcctctcctttttattttaggcactgttcaatactgtatgccttctgtattttaatggagtggatagcattgttttcttttacagactagcaggctactgggacctaaaaaggtctgttaatgtcatggccttgaaacagttccatttatgctggttaagagatcccttaagaagttagaaggcttaagaactgcttcatgtgaacatcccttattagttacaaagttatattcacagttttttaaaaatgtgtcaaaataaaggataactctgtattacagctttcacagta

SEQ ID NO: 290424 - DNA, 6798 bp, Homo sapiens
  misc_feature (347)..(347): n is a, c, g, or t
  misc_feature (402)..(402): n is a, c, g, or t
  misc_feature (457)..(457): n is a, c, g, or t
cgctgcaaatgccagggcagtgaagccgaacagaaaaccccatcgctttaaaaaggcagctgtccgccctccccctttcccctcgccaggcgaggcccctcaagtccgggatccgcgagctgcgcggaggatctcgccaaacccgagcaccgtgcggcgtcttttaagagctcgaacaacgggaatccagcaaaaaacaagccggccccagaaggcagcctccctcctctctccgcgcacgggctacaatcgcccccagtccccaaactgtcccagtagaggccgcgcggagagagcagagccgagggacccagcgcaaggcgggagccaagcgcggctgctttaanaacgcggagagcgcgcgcccgccgccagctggcccgggctgcgcgcccccgccgncaccgcgcgccccctgttcgctcgctccttcgctcgccggctttaaagtctctgncaggatccatgctcacatgttacttcctgtatggaggcatggccagtttccagccccgcgctcttcgttccttcccagcctgcgccggagccacaactttcaggagcatggactgaaggcgccctcgccccagcgcccctctgagatcctttgtgttttcctccgtttcctccggccgtttctattttggggggctctccgctccccctgcctctcccctccccttcccctctcgcaaacatgcctccttccttcccggggccctggaaggagctgcctgcctgaagcccggagacgccgcgccgcgctcagccccgccgccgcccgccggctctcgggctgtgctgcgctgccgactcaagttggggatcctcggctgctcgccgccgccgcccgcggtccctgcctgccccaggcccggggcatcgccgccggccgccgactccgcgccctgcccgatcggctctctcctttttaaacggaaagcagcctttctccgccgagaggatcgtccccagcgtggctctgcgttcccggtcactttttgagattttccggggggcgctcggcggcttcccggattccaaggggactcgggccgccgagcgcggggggcccgtggagcgggcgagccggggaagcgccccggcttagcggaggctcgcacggaggcaagaacttattcaacaagtttacctccctgctttcctcttttcgatgtgcgttttcggacatgcggaggttactggaaccgtgttggtggattttgttcctgaaaatcaccagttccgtgctccattatgtcgtgtgcttccccgcgttgacagaaggctacgttggggccctgcacgagaatagacacggcagcgcagtgcagatccgcaggcgcaaggcttcaggcgacccgtactgggcctactctggtgcctatggtcctgagcactgggtcacgtctagtgtcagctgtgggggccgtcaccagtctcctattgacattttagaccagtatgcgcgtgttggggaagaataccaggaactgcaactcgatggcttcgacaatgagtcttctaacaaaacctggatgaaaaacacagggaaaacagtcgccatccttctgaaagacgactattttgtcagtggagctggtctacctggcagattcaaagctgagaaggtggaatttcactggggccacagcaatggctcagcgggctctgaacacagcatcaatggcaggaggtttcctgttgagatgcagattttcttttacaatccagatgactttgacagctttcaaaccgcaatttctgagaacagaataatcggagccatggccatattttttcaagtcagtccgagggacaattctgcactggatcctattatccacgggttgaagggtgtcgtacatcatgagaaggagacctttctggatcctttcgtcctccgggacctcctgcctgcatccctgggcagctattatcggtacacaggttccttgaccacaccaccgtgtagcgaaatagtggagtggatagtcttccggagacccgtccccatctcttaccatcagcttgaggctttttattccatcttcaccacggagcagcaagaccatgtcaagtcggtggagtatctgagaaataactttcgaccacagcagcgtctgcatgacagggtggtgtccaagtccgccgtccgtgactcctggaaccacgacatgacagacttcttagaaaacccactggggacagaagcctctaaagtttgcagctctccacccatccacatgaaggtgcagcctctgaaccagacggcactgcaggtgtcctggagccagccggagactatctaccacccacccatcatgaactacatgatctcctacagctggaccaagaatgaggacgagaaggagaagacgtttacaaaggacagcgacaaagacttgaaagccaccattagccatgtctcacccgatagcctttacctgttccgagtccaggccgtgtgtcggaacgacatgcgcagcgactttagccagacgatgctgtttcaagctaataccactcgaatattccaagggaccagaatagtgaaaacaggagtgcccacagcgtctcctgcctcttcagccgacatggcccccatcagctcggggtcttctacctggacgtcctctggcatcccattctcatttgtttccatggcaactgggatgggcccctcctccagtggcagccaggccacagtggcctcggtggtcaccagcacgctgctcgccggcctggggttcggcggtggtggcatctcctctttccccagcactgtgtggcccacgcgcctcccgacggccgcctcagccagcaagcaggcggctaggccagtcctagccaccacagaggccttggcttctccagggcccgatggtgattcgtcaccaaccaaggacggcgagggcaccgaggaaggagagaaggatgagaaaagcgagagtgaggatggggagcgggagcacgaggaggatggagagaaggactccgaaaagaaggagaagagtggggtgacccacgctgccgaggagcggaatcagacggagcccagccccacaccctcgtctcctaacaggactgccgagggagggcatcagactatacctgggcatgagcaggatcacactgccgtccccacagaccagacgggcggaaggagggatgccggcccaggcctggaccccgacatggtcacctccacccaagtgccccccaccgccacagaggagcagtatgcagggagtgatcccaagaggcccgaaatgccatctaaaaagcctatgtcccgcggggaccgattttctgaagacagcagatttatcactgttaatccagcggaaaaaaacacctctggaatgataagccgccctgctccagggaggatggagtggatcatccctctgattgtggtatcagccttgaccttcgtgtgcctcatccttctcattgctgtgctcgtttactggagaaaatgttttcagactgctcatttctatgtggaagacagcagttcacctcgagtggtccctaatgaaagtattcctattattcctattccggatgacatggaagccattcctgtcaaacagtttgtcaaacacatcggtgagctctattctaataaccagcatgggttctctgaggattttgaggaagtccagcgctgtactgctgatatgaacatcactgcagagcattccaatcatccagaaaacaagcacaaaaacagatacatcaacattttagcatatgatcacagtagggtgaagttaagacctttaccaggaaaagactctaagcacagcgactacattaatgcaaactatgttgatggttacaacaaagcaaaagcctacattgccacccaaggacctttgaagtctacatttgaagatttctggaggatgatttgggaacaaaacactggaatcattgtgatgattacgaaccttgtggaaaaaggaagacgaaaatgtgatcagtattggccaacagagaacagtgaggaatatggaaacattattgtcacgctgaagagcacaaaaatacatgcctgctacactgttcgtcgtttttcaatcagaaatacaaaagtgaaaaagggtcagaagggaaatcccaagggtcgtcagaatgaaagggtagtgatccagtatcactatacacagtggcctgacatgggagttcccgagtatgcccttccagtactgactttcgtgaggagatcctcagcagctcggatgccagaaacgggccctgtgttggtgcactgcagtgctggtgtgggcagaacaggcacctatattgtaatagacagcatgctgcaacagataaaagacaaaagcacagttaacgtcctgggattcctgaagcatatcaggacacagcgtaactacctcgtccagactgaggagcagtacattttcatccatgatgccttgttggaagccattcttggaaaggagactgaagtatcttcaaatcagctgcacagctatgttaacagcatccttataccaggagtaggaggaaagacacgactggaaaagcaattcaagctggtcacacagtgtaatgcaaaatatgtggaatgtttcagtgctcagaaagagtgtaacaaagaaaagaacagaaactcttcagttgtgccatctgagcgtgctcgagtgggtcttgcaccattgcctggaatgaaaggaacagattacattaatgcttcttatatcatgggctattataggagcaatgaatttattataactcagcatcctctgccacatactacgaaagatttctggcgaatgatttgggatcataacgcacagatcattgtcatgctgccagacaaccagagcttggcagaagatgagtttgtgtactggccaagtcgagaagaatccatgaactgtgaggcctttaccgtcacccttatcagcaaagacagactgtgcctctctaatgaagaacaaattatcatccatgactttatccttgaagctacacaggatgactatgtcttagaagttcggcactttcagtgtcccaaatggcctaacccagatgcccccataagtagtacctttgaacttatcaacgtcatcaaggaagaggccttaacaagggatggtcccaccattgttcatgatgagtatggagcagtttcagcaggaatgttatgtgcccttaccaccctgtcccagcaactggagaatgaaaatgctgtggatgttttccaggttgcaaaaatgatcaatcttatgaggcctggagtattcacagacattgaacaataccagttcatctataaagcaatgcttagcttggtcagcactaaagaaaatggaaatggtcccatgacagtagacaaaaatggtgctgttcttattgcagatgaatcagaccctgctgagagcatggagtccctagtgtgactggaatcctgaaagggcacttaatttgtaaacttctgaagactgagaacttttttgaggccttttttgccagactctaggttatacaataacccagttacttttttacactgataaaagttttgatatttattttttgccattttatgtcttaatggtatcctactgagcatttgcacctctgttcatttcacacagtgaaacgcaattttacctagtttgcactatatgatcagtgttactgcctataatcttatacaacagcaaaccctgatgtgacattccatgacgacatacatgctacttttttttagttcaatacagtgaaggtctttgttatgacagtgaatattgcttttattattattattgctgaagtggttgcattctactagcaggcaatgctgtacttttcttcagtcctcctctcctttttattttaggcactgttcaatactgtatgccttctgtattttaatggagtggatagcattgttttcttttacagactagcaggctactgggacctaaaaaggtctgttaatgtcatggccttgaaacagttccatttatgctggttaagagatcccttaagaagttagaaggcttaagaactgcttcatgtgaacatcccttattagttacaaagttatattcacagttttttaaaaatgtgtcaaaataaaggataactctgtattacagctttcacagtagctatgtggacaatgtgttatttccattttgactctctaaaatagctacatcctaaaatcagggctatctttaacaatagcaagatagcaatattatatacaactcagttatgagaccctttagttattctccattaatgcttcttagtttgtaataccatacctcacagtaggtagaagaatgaaaacttctgcaggtgtgtaattttgaaactagtcctctaaaaattccctattactcctatagcaatctaataaaaactacctacatagttactgttttctttccttctttgccaaatgttttataataaatctcttaattacatacatttttctacttaagattaaattggaaatactgtattagcaaaagtcttgggactatctaaactcccacacatagataaatctgatttggagagagaaatttaaaatatttaattaaaggtgatacccacattttcaagtttttaaaagagggagatggctttgtatgcttttgtgtagtttagaacagatacacattagtaaaagataccaataatcattagagctcaaggaagttattaggtgcagcctctggagccatactcacgctgcagtgcataatgggaaaattaggagcattaataagaaat

SEQ ID NO: 290425 - DNA, 3441 bp, Homo sapiens
gtcgggaggatccctcgtccctaggtatctagagagggtgtaacaaaataaagtccaagggctttcccagacgtttccgtgaagtgccttcttctggggagagaggagagaaggggagcagaaaatgttttcagactgctcatttctatgtggaagacagcagttcacctcgagtggtccctaatgaaagtattcctattattcctattccggatgacatggaagccattcctgtcaaacagtttgtcaaacacatcggtgagctctattctaataaccagcatgggttctctgaggattttgaggaagtccagcgctgtactgctgatatgaacatcactgcagagcattccaatcatccagaaaacaagcacaaaaacagatacatcaacattttagcatatgatcacagtagggtgaagttaagacctttaccaggaaaagactctaagcacagcgactacattaatgcaaactatgttgatggttacaacaaagcaaaagcctacattgccacccaaggacctttgaagtctacatttgaagatttctggaggatgatttgggaacaaaacactggaatcattgtgatgattacgaaccttgtggaaaaaggaagacgaaaatgtgatcagtattggccaacagagaacagtgaggaatatggaaacattattgtcacgctgaagagcacaaaaatacatgcctgctacactgttcgtcgtttttcaatcagaaatacaaaagtgaaaaagggtcagaagggaaatcccaagggtcgtcagaatgaaagggtagtgatccagtatcactatacacagtggcctgacatgggagttcccgagtatgcccttccagtactgactttcgtgaggagatcctcagcagctcggatgccagaaacgggccctgtgttggtgcactgcagtgctggtgtgggcagaacaggcacctatattgtaatagacagcatgctgcaacagataaaagacaaaagcacagttaacgtcctgggattcctgaagcatatcaggacacagcgtaactacctcgtccagactgaggagcagtacattttcatccatgatgccttgttggaagccattcttggaaaggagactgaagtatcttcaaatcagctgcacagctatgttaacagcatccttataccaggagtaggaggaaagacacgactggaaaagcaattcaagctggtcacacagtgtaatgcaaaatatgtggaatgtttcagtgctcagaaagagtgtaacaaagaaaagaacagaaactcttcagttgtgccatctgagcgtgctcgagtgggtcttgcaccattgcctggaatgaaaggaacagattacattaatgcttcttatatcatgggctattataggagcaatgaatttattataactcagcatcctctgccacatactacgaaagatttctggcgaatgatttgggatcataacgcacagatcattgtcatgctgccagacaaccagagcttggcagaagatgagtttgtgtactggccaagtcgagaagaatccatgaactgtgaggcctttaccgtcacccttatcagcaaagacagactgtgcctctctaatgaagaacaaattatcatccatgactttatccttgaagctacacaggatgactatgtcttagaagttcggcactttcagtgtcccaaatggcctaacccagatgcccccataagtagtacctttgaacttatcaacgtcatcaaggaagaggccttaacaagggatggtcccaccattgttcatgatgagtatggagcagtttcagcaggaatgttatgtgcccttaccaccctgtcccagcaactggagaatgaaaatgctgtggatgttttccaggttgcaaaaatgatcaatcttatgaggcctggagtattcacagacattgaacaataccagttcatctataaagcaatgcttagcttggtcagcactaaagaaaatggaaatggtcccatgacagtagacaaaaatggtgctgttcttattgcagatgaatcagaccctgctgagagcatggagtccctagtgtgactggaatcctgaaagggcacttaatttgtaaacttctgaagactgagaacttttttgaggccttttttgccagactctaggttatacaataacccagttacttttttacactgataaaagttttgatatttattttttgccattttatgtcttaatggtatcctactgagcatttgcacctctgttcatttcacacagtgaaacgcaattttacctagtttgcactatatgatcagtgttactgcctataatcttatacaacagcaaaccctgatgtgacattccatgacgacatacatgctacttttttttagttcaatacagtgaaggtctttgttatgacagtgaatattgcttttattattattattgctgaagtggttgcattctactagcaggcaatgctgtacttttcttcagtcctcctctcctttttattttaggcactgttcaatactgtatgccttctgtattttaatggagtggatagcattgttttcttttacagactagcaggctactgggacctaaaaaggtctgttaatgtcatggccttgaaacagttccatttatgctggttaagagatcccttaagaagttagaaggcttaagaactgcttcatgtgaacatcccttattagttacaaagttatattcacagttttttaaaaatgtgtcaaaataaaggataactctgtattacagctttcacagtagctatgtggacaatgtgttatttccattttgactctctaaaatagctacatcctaaaatcagggctatctttaacaatagcaagatagcaatattatatacaactcagttatgagaccctttagttattctccattaatgcttcttagtttgtaataccatacctcacagtaggtagaagaatgaaaacttctgcaggtgtgtaattttgaaactagtcctctaaaaattccctattactcctatagcaatctaataaaaactacctacatagttactgttttctttccttctttgccaaatgttttataataaatctcttaattacatacatttttctacttaagattaaattggaaatactgtattagcaaaagtcttgggactatctaaactcccacacatagataaatctgatttggagagagaaatttaaaatatttaattaaaggtgatacccacattttcaagtttttaaaagagggagatggctttgtatgcttttgtgtagtttagaacagatacacattagtaaaagataccaataatcattagagctcaaggaagttattaggtgcagcctctggagccatactcacgctgcagtgcataatgggaaaattaggagcattaataagaaat

SEQ ID NO: 290426 - DNA, 4930 bp, Homo sapiens
  misc_feature (347)..(347): n is a, c, g, or t
  misc_feature (402)..(402): n is a, c, g, or t
  misc_feature (457)..(457): n is a, c, g, or t
cgctgcaaatgccagggcagtgaagccgaacagaaaaccccatcgctttaaaaaggcagctgtccgccctccccctttcccctcgccaggcgaggcccctcaagtccgggatccgcgagctgcgcggaggatctcgccaaacccgagcaccgtgcggcgtcttttaagagctcgaacaacgggaatccagcaaaaaacaagccggccccagaaggcagcctccctcctctctccgcgcacgggctacaatcgcccccagtccccaaactgtcccagtagaggccgcgcggagagagcagagccgagggacccagcgcaaggcgggagccaagcgcggctgctttaanaacgcggagagcgcgcgcccgccgccagctggcccgggctgcgcgcccccgccgncaccgcgcgccccctgttcgctcgctccttcgctcgccggctttaaagtctctgncaggatccatgctcacatgttacttcctgtatggaggcatggccagtttccagccccgcgctcttcgttccttcccagcctgcgccggagccacaactttcaggagcatggactgaaggcgccctcgccccagcgcccctctgagatcctttgtgttttcctccgtttcctccggccgtttctattttggggggctctccgctccccctgcctctcccctccccttcccctctcgcaaacatgcctccttccttcccggggccctggaaggagctgcctgcctgaagcccggagacgccgcgccgcgctcagccccgccgccgcccgccggctctcgggctgtgctgcgctgccgactcaagttggggatcctcggctgctcgccgccgccgcccgcggtccctgcctgccccaggcccggggcatcgccgccggccgccgactccgcgccctgcccgatcggctctctcctttttaaacggaaagcagcctttctccgccgagaggatcgtccccagcgtggctctgcgttcccggtcactttttgagattttccggggggcgctcggcggcttcccggattccaaggggactcgggccgccgagcgcggggggcccgtggagcgggcgagccggggaagcgccccggcttagcggaggctcgcacggaggcaagaacttattcaacaagtttacctccctgctttcctcttttcgatgtgcgttttcggacatgcggaggttactggaaccgtgttggtggattttgttcctgaaaatcaccagttccgtgctccattatgtcgtgtgcttccccgcgttgacagaaggctacgttggggccctgcacgagaatagacacggcagcgcagtgcagatccgcaggcgcaaggcttcaggcgacccgtactgggcctactctggtgcctatggtcctgagcactgggtcacgtctagtgtcagctgtgggggccgtcaccagtctcctattgacattttagaccagtatgcgcgtgttggggaagaataccaggaactgcaactcgatggcttcgacaatgagtcttctaacaaaacctggatgaaaaacacagggaaaacagtcgccatccttctgaaagacgactattttgtcagtggagctggtctacctggcagattcaaagctgagaaggtggaatttcactggggccacagcaatggctcagcgggctctgaacacagcatcaatggcaggaggtttcctgttgagatgcagattttcttttacaatccagatgactttgacagctttcaaaccgcaatttctgagaacagaataatcggagccatggccatattttttcaagtcagtccgagggacaattctgcactggatcctattatccacgggttgaagggtgtcgtacatcatgagaaggagacctttctggatcctttcgtcctccgggacctcctgcctgcatccctgggcagctattatcggtacacaggttccttgaccacaccaccgtgtagcgaaatagtggagtggatagtcttccggagacccgtccccatctcttaccatcagcttgaggctttttattccatcttcaccacggagcagcaagaccatgtcaagtcggtggagtatctgagaaataactttcgaccacagcagcgtctgcatgacagggtggtgtccaagtccgccgtccgtgactcctggaaccacgacatgacagacttcttagaaaacccactggggacagaagcctctaaagtttgcagctctccacccatccacatgaaggtgcagcctctgaaccagacggcactgcaggtgtcctggagccagccggagactatctaccacccacccatcatgaactacatgatctcctacagctggaccaagaatgaggacgagaaggagaagacgtttacaaaggacagcgacaaagacttgaaagccaccattagccatgtctcacccgatagcctttacctgttccgagtccaggccgtgtgtcggaacgacatgcgcagcgactttagccagacgatgctgtttcaagctaataccactcgaatattccaagggaccagaatagtgaaaacaggagtgcccacagcgtctcctgcctcttcagccgacatggcccccatcagctcggggtcttctacctggacgtcctctggcatcccattctcatttgtttccatggcaactgggatgggcccctcctccagtggcagccaggccacagtggcctcggtggtcaccagcacgctgctcgccggcctggggttcggcggtggtggcatctcctctttccccagcactgtgtggcccacgcgcctcccgacggccgcctcagccagcaagcaggcggctaggccagtcctagccaccacagaggccttggcttctccagggcccgatggtgattcgtcaccaaccaaggacggcgagggcaccgaggaaggagagaaggatgagaaaagcgagagtgaggatggggagcgggagcacgaggaggatggagagaaggactccgaaaagaaggagaagagtggggtgacccacgctgccgaggagcggaatcagacggagcccagccccacaccctcgtctcctaacaggactgccgagggagggcatcagactatacctgggcatgagcaggatcacactgccgtccccacagaccagacgggcggaaggagggatgccggcccaggcctggaccccgacatggtcacctccacccaagtgccccccaccgccacagaggagcagtatgcagggagtgatcccaagaggcccgaaatgccatctaaaaagcctatgtcccgcggggaccgattttctgaagacagcagatttatcactgttaatccagcggaaaaaaacacctctggaatgataagccgccctgctccagggaggatggagtggatcatccctctgattgtggtatcagccttgaccttcgtgtgcctcatccttctcattgctgtgctcgtttactggagaaaatgttttcagactgctcatttctatgtggaagacagcagttcacctcgagtggtccctaatgaaagtattcctattattcctattccggatgacatggaagccattcctgtcaaacagtttgtcaaacacatcggtgagctctattctaataaccagcatgggttctctgaggattttgaggaagtccagcgctgtactgctgatatgaacatcactgcagagcattccaatcatccagaaaacaagcacaaaaacagatacatcaacattttagcatatgatcacagtagggtgaagttaagacctttaccaggaaaagactctaagcacagcgactacattaatgcaaactatgttgatggttacaacaaagcaaaagcctacattgccacccaaggacctttgaagtctacatttgaagatttctggaggatgatttgggaacaaaacactggaatcattgtgatgattacgaaccttgtggaaaaaggaagacgaaaatgtgatcagtattggccaacagagaacagtgaggaatatggaaacattattgtcacgctgaagagcacaaaaatacatgcctgctacactgttcgtcgtttttcaatcagaaatacaaaagtgaaaaagggtcagaagggaaatcccaagggtcgtcagaatgaaagggtagtgatccagtatcactatacacagtggcctgacatgggagttcccgagtatgcccttccagtactgactttcgtgaggagatcctcagcagctcggatgccagaaacgggccctgtgttggtgcactgcagtgctggtgtgggcagaacaggcacctatattgtaatagacagcatgctgcaacagataaaagacaaaagcacagttaacgtcctgggattcctgaagcatatcaggacacagcgtaactacctcgtccagactgaggagcagtacattttcatccatgatgccttgttggaagccattcttggaaaggagactgaagtatcttcaaatcagctgcacagctatgttaacagcatccttataccaggagtaggaggaaagacacgactggaaaagcaattcaagctggtcacacagtgtaatgcaaaatatgtggaatgtttcagtgctcagaaagagtgtaacaaagaaaagaacagaaactcttcagttgtgccatctgagcgtgctcgagtgggtcttgcaccattgcctggaatgaaaggaacagattacattaatgcttcttatatcatgggctattataggagcaatgaatttattataactcagcatcctctgccacatactacgaaagatttctggcgaatgatttgggatcataacgcacagatcattgtcatgctgccagacaaccagagcttggccgaagatgagtttgtgtcggccgcagtctttggcaagaaagggatcctctagaacgccgc

SEQ ID NO: 290427 - DNA, 313 bp, Homo sapiens
gcagaagatgagtttgtgtactggccaagtcgagaagaatccatgaactgtgaggcctttaccgtcacccttatcagcaaagacagactgtgcctctctaatgaagaacaaattatcatccatgactttatccttgaagctacacaggtaacctaaacctcagttcctcactaatagccatacctgggccctggatcatcattctaagtaataatgaaataatttaccaccctcaagccaggctcaggcatttgagtaagacttaattttaaatatgtacattttccgtttttcttccttcaaatatttgctt

SEQ ID NO: 290428 - DNA, 671 bp, Homo sapiens
agccccgggaggtgcagggcccagtctgcccatctcgaccccagtgctctcctgccaggctgccctccggcccggccccaggtccatcttcatgtactcctcagtgccagtctcttcctctctgggagctggctggagctgggatggacacctgacagaaggaaattaaaattttaagggctaattccccttcattcaagaaatatttactgtgatgaagacatgttccatgcagaggaaatggccaatgcaaagagcccctgactggagggcatttggcacattctaggagagtgaggaggattctatgggccaggaattcagacagggcacagtgttgatggcttgtctgtgtcctggctgggatggctcaaatggttgtgggactatttgacttgaaaggctggagcctggaatcatttgaaacattgttcactcatgtgtctggcacctgcgttagaatgactgaaggctacatcaactagagtacttacatccggtctctccatgtgacttggacttttcacagcgtggaggctggatttcaaaggtcaactgagaatggcagaggactcatcccacctttgccacatggtgacttgccccactcccccaggtgaccttgctcgtgcatgtggatatttgctcagattaagaatgtttcccacaaa

SEQ ID NO: 290429 - DNA, 1147 bp, Homo sapiens
ttatgcttcatgtctttattgaataggttcaaatatgaagacattattggtgaaaaaacaaaaaacaaatagtggacaagaaataatagtcaccacaatcatctttttcaacctaacacaattcagaataatacataagcaatttttacatttttaatcttacaatcatcttttattctaccatactgtcaaatacttgtgaaaataaataaaaataaaatacatgatgcataggaagattttttttaaaactgaactattgcacaaatcaatgtgagaatatgcaagtaatataaaaatgcatttaaatatattgtcacaacatatttcgtaagtcataaatctatttcacctactgtttataatctctgggctctggaactagatgatttcttaccaactcatctccatgtggtacattataacattaatttactactgtaaaattcagtgagaaacaaatgtgtgccaattatttatctatcctttccttgagcagacaaaaagaattatgtggtcttaaaaaatacttgacaaaaaaacagtgctcagtattagataaaacaagtttaaagttctttatatgatttataacagaagtgatttaaatggaaatctaatatatgcattcatcttctaaattcattacagcttattttagttgatggactatttgtttctttgttttgacccataagactgaataaagataactgaggggaaaaaaattaacaactaatcaggaaataaactgtaagtaaaatgaccattcctattaagtttgtaactcctgcccaaactaaactaagctaataaatttcagataaattataagccacaattctttacattgtgtcttatagttgatcagaatcataaacaaaaaaaaaagctaggaattatataagagatttgtttgtacctttacagtaagatcaaagctctcttaggtttgattgaatagaaattactacagaattactgccatcaaggcaatctactactaactactatgatatactgaaagtgacaatgattaagagctgtgtcgtgatcaggttaaagagaacaaaaataattaaatttgtgtgtatgtttaattaggtaagtcaattatgcattaaaacaatacattttcagtggtcct

SEQ ID NO: 290430 - DNA, 2302 bp, Homo sapiens
tttcagtttccacgtcctgcgtttaatttggggtttgattttccaaatacaacacttaccagattaggtggacccacaggattatttttccttgaggtctcacctgagcaggtgcatgtacagcagacggagcagaaagagactgattagagaggttggagtggtagagggcgtgaccctcttaatcattcttcacttccttttttaaaagacgacttggcatcgtccaccacatccgcggcaacgcctccttggtgtcgtccgcttccaataacccagcttgcgtcctgcacacttgtggcttccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctccaagaatctatctgcttatgcagtttttcagagtggaatgcttcctagaagttactgaatgcaccatggtcaaaacggattagggcatttgagaaatgcatattgtattactagaagatgaatacaaacaatggaaactgaatgctccagtcaacaaactatttcttatatatgtgaacatttatcaatcagtataattctgtactgatttttgtaagacaatccatgtaaggtatcagttgcaataatacttctcaaacctgtttaaatatttcaagacattaaatctatgaagtatataatggtttcaaagattcaaaattgacattgctttactgtcaaaataattttatggctcactatgaatctattatactgtattaagagtgaaaattgtcttcttctgtgctggagatgttttagagttaacaatgatatatggataatgccggtgagaataagagagtcataaaccttaagtaagcaacagcataacaaggtccaagatacctaaaagagatttcaagagatttaattaatcatgaatgtgtaacacagtgccttcaataaatggtatagcaaatgttttgacatgaaaaaaggacaatttcaaaaaaataaaataaaataaaaataaattcacctagtctaaggatgctaaaccttagtactgagttacattgtcatttatatagattataacttgtctaaataagtttgcaatttgggagatatatttttaagataataatatatgtttaccttttaattaatgaaatatctgtatttaattttgacactatatctgtatataaaatattttcatacagcattacaaattgcttactttggaatacatttctcctttgataaaataaatgagctatgt

SEQ ID NO: 290431 - DNA, 2170 bp, Homo sapiens
tttcagtttccacgtcctgcgtttaatttggggtttgattttccaaatacaacacttaccagattaggtggacccacaggattatttttccttgaggtctcacctgagcaggtgcatgtacagcagacggagcagaaagagactgattagagaggttggagtggtagagggcgtgaccctcttaatcattcttcacttccttttttaaaagacgacttggcatcgtccaccacatccgcggcaacgcctccttggtgtcgtccgcttccaataacccagcttgcgtcctgcacacttgtggcttccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctccaagaatctatctgcttatgcagtttttcagagtggaatgcttcctagaagttactgaatgcaccatggtcaaaacggattagggcatttgagaaatgcatattgtattactagaagatgaatacaaacaatggaaactgaatgctccagtcaacaaactatttcttatatatgtgaacatttatcaatcagtataattctgtactgatttttgtaagacaatccatgtaaggtatcagttgcaataatacttctcaaacctgtttaaatatttcaagacattaaatctatgaagtatataatggtttcaaagattcaaaattgacattgctttactgtcaaaataattttatggctcactatgaatctattatactgtattaagagtgaaaattgtcttcttctgtgctggagatgttttagagttaacaatgatatatggataatgccggtgagaataagagagtcataaaccttaagtaagcaacagcataacaaggtccaagatacctaaaagagatttcaagagatttaattaatcatgaatgtgtaacacagtgccttcaataaatggtatagcaaatgttttgacatgaaaaaaggacaatttcaaaaaaataaaataaaataaaaataaattcacctagtctaaggatgctaaaccttagtactgagttacattgtcatttatatagattataacttgtctaaataagtttgcaatttgggagatatatttttaagataataatatatgtttaccttttaattaatgaaatatctgtatttaattttgacactatatctgtatataaaatattttcatacagcattacaaattgcttactttggaatacatttctcctttgataaaataaatgagctatgt

SEQ ID NO: 290432 - DNA, 2246 bp, Homo sapiens
tttcagtttccacgtcctgcgtttaatttggggtttgattttccaaatacaacacttaccagattaggtggacccacaggattatttttccttgaggtctcacctgagcaggtgcatgtacagcagacggagcagaaagagactgattagagaggttggagtggtagagggcgtgaccctcttaatcattcttcacttccttttttaaaagacgacttggcatcgtccaccacatccgcggcaacgcctccttggtgtcgtccgcttccaataacccagcttgcgtcctgcacacttgtggcttccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctccaagaatctatctgcttatgcagtttttcagagtggaatgcttcctagaagttactgaatgcaccatggtcaaaacggattagggcatttgagaaatgcatattgtattactagaagatgaatacaaacaatggaaactgaatgctccagtcaacaaactatttcttatatatgtgaacatttatcaatcagtataattctgtactgatttttgtaagacaatccatgtaaggtatcagttgcaataatacttctcaaacctgtttaaatatttcaagacattaaatctatgaagtatataatggtttcaaagattcaaaattgacattgctttactgtcaaaataattttatggctcactatgaatctattatactgtattaagagtgaaaattgtcttcttctgtgctggagatgttttagagttaacaatgatatatggataatgccggtgagaataagagagtcataaaccttaagtaagcaacagcataacaaggtccaagatacctaaaagagatttcaagagatttaattaatcatgaatgtgtaacacagtgccttcaataaatggtatagcaaatgttttgacatgaaaaaaggacaatttcaaaaaaataaaataaaataaaaataaattcacctagtctaaggatgctaaaccttagtactgagttacattgtcatttatatagattataacttgtctaaataagtttgcaatttgggagatatatttttaagataataatatatgtttaccttttaattaatgaaatatctgtatttaattttgacactatatctgtatataaaatattttcatacagcattacaaattgcttactttggaatacatttctcctttgataaaataaatgagctatgt

SEQ ID NO: 290433 - DNA, 2272 bp, Homo sapiens
cctggactgtgaactttcagtgctgctcttttttttcccctccttaggtggtacagggcagccttccaacatgtgaaaaactagaggacccttgagctgggtatttttttccccaggcagatcagactctgataaaacctcagaaggttaggctctggtaaaatagtcacccttgagtttaggccctttaaaggagaacagactattcagctttttagaaattagtattttttttttgagacagggtcttactgtcacccaggctggagtgcagtgatataaatcatggctcactgcagccttgacctcctgggttcaagtgatgctcctatttcaacctgagtagctgggaccaccagcatgtgccaccatgcatggctaatttttttgtaattgtttgtaaagataggatctcactatgttgtccaggctggtctcaaacttctgggctcaagtgatcctcccacctctggcttattttataatagttttttcccctcctcctaccagaagcacaagaggactttctcatctgatacttactgtgaggacctagtagttagagctcctaaagatcaaactcataaaagtatatagcccccacaactatgactgggtacccttggagtttttaattctctaagttgtttcacactgagccttcagcaatttgccaattacagtttaattttttctacccccacaatggttgctatggaggtttctgctcatggatctctgcttcaaatcagccctacaaaaagaaagaaaaaagaacagaaaggaagcagcaatcagctatgagcaataattagacattcgtttgctagctctagcacatgtgaccatgaagagtaactgtgaaccatattgactttctctcctgaaaagaaaaatatgaaaaaaattcagaagaaaactgtcctatcacaaagaatacagaaattgggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctccaagaatctatctgcttatgcagtttttcagagtggaatgcttcctagaagttactgaatgcaccatggtcaaaacggattagggcatttgagaaatgcatattgtattactagaagatgaatacaaacaatggaaactgaatgctccagtcaacaaactatttcttatatatgtgaacatttatcaatcagtataattctgtactgatttttgtaagacaatccatgtaaggtatcagttgcaataatacttctcaaacctgtttaaatatttcaagacattaaatctatgaagtatataatggtttcaaagattcaaaattgacattgctttactgtcaaaataattttatggctcactatgaatctattatactgtattaagagtgaaaattgtcttcttctgtgctggagatgttttagagttaacaatgatatatggataatgccggtgagaataagagagtcataaaccttaagtaagcaacagcataacaaggtccaagatacctaaaagagatttcaagagatttaattaatcatgaatgtgtaacacagtgccttcaataaatggtatagcaaatgttttgacatgaaaaaaggacaatttcaaaaaaataaaataaaataaaaataaattcacctagtctaaggatgctaaaccttagtactgagttacattgtcatttatatagattataacttgtctaaataagtttgcaatttgggagatatatttttaagataataatatatgtttaccttttaattaatgaaatatctgtatttaattttgacactatatctgtatataaaatattttcatacagcattacaaattgcttactttggaatacatttctcctttgataaaataaatgagctatgt

SEQ ID NO: 290434 - DNA, 1664 bp, Homo sapiens
tttcagtttccacgtcctgcgtttaatttggggtttgattttccaaatacaacacttaccagattaggtggacccacaggattatttttccttgaggtctcacctgagcaggtgcatgtacagcagacggagcagaaagagactgattagagaggttggagtggtagagggcgtgaccctcttaatcattcttcacttccttttttaaaagacgacttggcatcgtccaccacatccgcggcaacgcctccttggtgtcgtccgcttccaataacccagcttgcgtcctgcacacttgtggcttccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttgtcctcaggactacagaagcagttcacattttacagatcaaacggacgacacacacattctttccactgcaaattgtcctttctccactagaaggtatcagtttctccaaataaattgtatcaacttgagggcagacacttaattacatcttattatctcgatccccatcattgcatatccagaaagagcacataaagcgtttttcaatgcttattttagttgatggactatttgtttctttgttttgacccataagactgaataaagataactgaggggaaaaaaattaacaactaatcaggaaataaacttttttcggatttatgaaataatttgttgacatgctctacaggagtgaccttaacatacctaatggtaactaaaactgttctctttaattacaaaattcccagcatctatcctactatgatactatctgaagataggcaccaataatacaaatgtttatccaaa

SEQ ID NO: 290435 - DNA, 1416 bp, Homo sapiens
tttcagtttccacgtcctgcgtttaatttggggtttgattttccaaatacaacacttaccagattaggtggacccacaggattatttttccttgaggtctcacctgagcaggtgcatgtacagcagacggagcagaaagagactgattagagaggttggagtggtagagggcgtgaccctcttaatcattcttcacttccttttttaaaagacgacttggcatcgtccaccacatccgcggcaacgcctccttggtgtcgtccgcttccaataacccagcttgcgtcctgcacacttgtggcttccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggtggaactgatcattccttcatgtatgcctccactgctcagctcaacaagtaactcttaataacctaccacctgttatctctgggagagggacatatgtttgccaatttctatcttcaatgcttatcacaaattttcttatatttgaaataatctgattcaaatgagaactttaacctaaaactttaattggaaagacaatcttataaaaatcttataacatattc

SEQ ID NO: 290436 - DNA, 502 bp, Homo sapiens
aagatcgtgccactgcactgcagcctggacaacagcgcaagactccatctcaaaaaaaagaaaaattactggtgaaaaggccatcttccagaataccatgaggttagtggttgctatcttctggggaaagatgcccaactgcatttaatatttccaaactagaaacacaaggccctggtttgaaagcaactcatgatcttctgaatgctattcccctccaccctttgcccttgcccccaagtgcaggggcagtgtagttctacagggctgtcattctacaaatcctggtgccctttaaaaaaaaaaacaaaacaaacaaacaaaaaacggcggtacggtggctcacacctgtaatcccagcctttgggaggctgagatgggcagagcacttgaggtcaggagttcaagacagcctggccaacacagtgaaaccccatctctattaaaaatacaaaaattagccaggcatggtggcacacccctgtaatcccagctactcggg

SEQ ID NO: 290437 - DNA, 451 bp, Homo sapiens
aagatcgtgccactgcactgcagcctggacaacagcgcaagactccatctcaaaaaaaagaaaaattactggtgaaaaggccatcttccagaataccatgagagacaaggtttccctctgtaacccaggctggagtgcagtggaacttctgagctcaagtagtcttcacatctcagccttccaagtagctgtgactagagcttgtgacagtccagccccttcagcctggagttccacctaccagtccccacatgtgctgtctctcaccaaggttgccagtgacctctgaccaaaacaatctttggctccccatcactggcctgtcctatgggaaaacatttgcattccttaactcagcctagaaggcctctgtgacttgctgtctacttatctggcccttctcatgcttcctttctggctgtagcaaccttgaagatatcgtacttcccca

SEQ ID NO: 290438 - DNA, 327 bp, Homo sapiens
aacataatgtaaaacacttcatagtgagagacaaaatgaatgcacgattctctagcaaggccagtattcttcaatcagctttgagaacctacatttcttattttggtaaactactgtcatgtttcctcaattgtgttaattgatctaccaggaagaagacaaaaatgagtttctagtacctttattaagaaaccctgttaagattggaaggctgatggaacctgggtctggaccagatccgtgagatcagagtggtttaacagcttttatggtctgtttttgctgattcttacttttctgtttgtgcctagaagtctggaacgtttt

SEQ ID NO: 290439 - DNA, 660 bp, Homo sapiens
cgtctctacttaaaatacaaaattagcagggtgtggtggtgcatgcctgtaatcccagctacttgggaggctgaggcagaggttgcagtgagatgagatcgtgtcattgcactccagcctgggcaacaacgtgaaactccgtctcaaaaaaaaaaaattgtttcattgttgaataaaaagaaaaataagttatgtcattggtggacagaatcaacttatatctgaataaaataactataccaattaaaactaaagtaggccaggcgtagtggctcacgcctataatcccagcactttgggaggccaaggtgggtggatcatttgcgatcaggagtttgagaccagcgtggccaacatagtgaaaccctgtctctactaaaaatacaaaattagccaggcaaggtggtgggcacctgtagtcccagctacttggaggattgaggcaggagaatcgcttgaacctgggaagcagaggttgcagtgagctgagatcacaccactatactccagcctaggcaagagtaagactccatctcaaaaaaaaaataaaaataaaaataaaataaaaacaaaaactaaagttaaaaggtctggtatactgaactggtaaactaattacaattttgctttccaacctcctcaagtatttaaaagacccaa

SEQ ID NO: 290440 - DNA, 878 bp, Homo sapiens
aaaggcacacgcgcttcccggcgccggcttccggcccggcgaggtttgagcgcgtccgcgggctgggaggccgctggacccgggcgcatggcctcccccgggcagttatctccttgccgcgaccttgaggtcttcggtaagaactggcgttcctctttctaacgccggctttcggccttcgcccttgacgcccaggcccggggaggccgtcactcagaaactgctccatccgagtccgccgcctcggagatgccgagagcctggtcctgccctctgcccccggccccttcctagactcactacttcagaccgtgtgctgtcctggagccagtgaaaccagacgaaattaagggaacagcagacgaaggaactgccaccgtgccccagaccctggtttgcaaatacagttcgacaaagatcttgccaggaattggcctgggagagtccaaaggactgggctgggggtggggaaatgattttagccagaagacaaatatagaggttgtacccagaaggttaagaggcttaggaaggttaagaactacgttaacatttggctcccaggaccccaggtaaagtgcccttggattgaatagatttctgaactccagaaacatttagaggaatcaatagaattagattggcagccattgtgccaatggacaagtgcttactgagccccttaatcccttcactgggtaagcatttgccacacatgtcctcaaaaacctacttgttagcttaagtggactccctcaagttcagaacaggagcaaatagtgtaatcacaagttccgtgtctgaataatcataacaatgtttataaaaataaggacgactgttgaaaactgcaactgcagctgaaccttatgtgccca

SEQ ID NO: 290441 - DNA, 380 bp, Homo sapiens
aaaggcacacgcgcttcccggcgccggcttccggcccggcgaggtttgagcgcgtccgcgggctgggaggccgctggacccgggcgcatggcctcccccgggcagttatctccttgccgcgaccttgaggtcttcggtaagaactggcgttcctctttctaacgccggctttcggccttcgcccttgacgcccaggcccggggaggccgtcactcagaaactgctccatccgagtccgccgcctcggagatgccgagagcctggtcctgccctctgcccccggccccttcctagactcactacttcaggtcactaaaggcgcctcccaccagtttgacttctgttctgcctctgcgccccgctctggcctctcctaagcc

SEQ ID NO: 290442 - DNA, 3692 bp, Homo sapiens
  misc_feature (1)..(1): n is a, c, g, or t
  misc_feature (93)..(93): n is a, c, g, or t
  misc_feature (318)..(318): n is a, c, g, or t
nctcaggatggctacttttctcatcggccgaaagagaaagtgcgaacagacagcaacaacgagaactctgtccccaaagactttgagaatgtngacaacagcaacttcgcacccaggactcaaaagcagaagcaccagcctgagttggcgaagaagccaccgagtagacagaaggagcttttgaaaaggaagctggaacagcaggagaaaggaaaaggacatacattccctgggaaaggccccggtgaggtgctgcctcccggggacagagccgcagccaacagcagccacgggaaggatgtgtccagaccgcctcangccaggaaaactgggggcagctcccccgagaccaagtatgaccagccccctaagtgtgacatctcaggcaaggaggccatctctgccctgtcccgtgctaagtccaagcactgccgccaggagattggggagacttactgccgccacaagttagggctgctgatgcctgagaaggtgactcggttctgccccctcgagggtaaagccaacaagaacgtgcagtgggacgaggactccgtggagtacatgccagccaacccggtcagaatcgcctttgtcctggtggtccacggccgtgcctctcggcagttgcagcgcatgttcaaggccatctaccacaaagaccacttctactacatccacgtggacaagcgctctaattacctgcatcggcaagtgctccaggtctccaggcagtacagcaatgtccgcgtcaccccctggagaatggccaccatctggggaggagccagcctcctgtccacctacctgcagagcatgcgggacctcctggagatgaccgactggccctgggacttcttcatcaacctgagtgcggccgactaccccatcaggacaaatgaccagttggtggcgtttctctcccgataccgagatatgaatttcttgaagtcacacggccgggacaatgcaaggttcattcggaagcagggcctggatcggctcttcctggagtgcgacgctcacatgtggcgcctgggagatcggcggatcccagagggcattgccgtggatggcggttcggactggttcctgctgaaccggaggtttgtagaatatgtgaccttctccacagacgatctggtgaccaagatgaaacagttctactcctacaccctgcttcctgctgagtccttcttccatacggtcctggagaacagcccccactgcgacaccatggtggacaacaacctgcgcatcaccaactggaatcgcaagctgggctgcaagtgccagtacaagcacatcgtggactggtgcggctgctcccccaatgacttcaagccgcaggacttccaccgcttccagcagacagcccggcctaccttctttgcccgcaagtttgaagccgtggtgaatcaggaaatcattgggcagctggactattacctgtacgggaactaccctgcaggtaccccgggcctgcgctcctactgggagaatgtctacgatgagcctgacggcatccacagcctgagcgacgtgacactcaccttgtaccactcctttgcccgcctgggtcttcgacgggccgagacgtccctgcacacggatggggagaacagctgccgatactacccaatgggccacccagcatctgtgcacctctacttccttgctgaccgcttccagggctttctgatcaagcatcatgctaccaatctggctgtgagcaaactagagactctggagacctgggtgatgccgaaaaaagtcttcaagatcgcaagcccacccagtgactttgggaggcttcagttttccgaggtcggcactgactgggatgccaaggagaggctattccgcaactttgggggtcttctggggcccatggatgagccggtgggtatgcagaagtgggggaagggacctaatgtgaccgtgaccgtcatttgggtggatcccgtcaatgtcatcgcagccacctacgacatcctcattgagtccactgccgaattcacacactacaagccccctttgaacttgcccctgaggcctggggtctggacagtgaaaattctccaccactgggtgccagttgcagagaccaaattcctcgttgcgcctctgaccttctcgaacaggcagcccatcaaacctgaggaggcactgaagctgcacaatgggcccctccgcaatgcctacatggagcagagcttccagagcctaaaccccgtcctcagcctgcccatcaaccccgcccaggtggaacaggcacggaggaacgcagcctccacgggcacagcgctggagggatggctggactcgttggtgggcgggatgtggactgccatggacatctgtgccacgggccccacagcctgcccggtcatgcagacctgcagccagacggcctggagctccttcagccctgaccccaagtcggagctgggggcagtcaaacctgatggccggctcaggtagcactgggcacgaggagtgggccacagcaggatctcaacgggaaagcagccagaggggttgtggggcctgaaccccggcctcccaccctgggggaggccctctgtgaatgggtctctcctggccatagaatgatggaaagggaaggtcagcaggtcaaagcaggatcagccaacaacctgcctttggcaagctgcgggtgggatggctcagtccctgcactgtgactgtctcacctcttctggttgatcctcaagtcctacaggttccttgtcttccccttccagtgacccacccctgaccccagacgtgtgattttcagacttttctttcgagcagcagaacttcgtttacggagcacagtcataagtggaggttcagggtgctgacgaaatccaagctgctctggttgaagctgacaagtgcgaggttccctcccaaagctcagccctctgggcggtccccttgcccagggtatctcctacggtacctcttcagaacccaagggctctgcaaatgccagtttgacaagcactgcccagaccaaccatgggttcaaactccagccctgccctttggttcatttttctgcttctcttggctgggggactctggtgccagccttgaaagtcatggtcgtgggccctttcccatggaggctgcagccttaggagagctctgagcctctcagcagccctccttgggttgaactattctccttagtaactaggtaagtgggaaagccttttgatgtggcatggccaaggtccagccacaagtgcaactgccacctgtccaggggtctgggcctccttccctcaaggctgccacacaaagtagcagaaataggatgatgtttgtgagcaccagactcaagaccatgaccttctttgatccttgaaaatgggaactttgacagccatgaccatgaaactcacaaggcaacgcgatgaaactcacaaagcaatgcttggagcaaaactcctgagctagacagcacagcagcacccatcccctgccagagcccttccgttctgaggtcagacacacaaaaccttcgtcaattgcacaccggtgctgttgggagtgaccaaaccacatgaaccagacttttcccgtccaggaaatagcatttcagatttggtttttaatttcatgcccttcggccacaggctcaacgggacatgcaacataaaaatgggaaggttatt

SEQ ID NO: 290443 - DNA, 3784 bp, Homo sapiens
  misc_feature (1)..(1): n is a, c, g, or t
  misc_feature (93)..(93): n is a, c, g, or t
  misc_feature (318)..(318): n is a, c, g, or t
nctcaggatggctacttttctcatcggccgaaagagaaagtgcgaacagacagcaacaacgagaactctgtccccaaagactttgagaatgtngacaacagcaacttcgcacccaggactcaaaagcagaagcaccagcctgagttggcgaagaagccaccgagtagacagaaggagcttttgaaaaggaagctggaacagcaggagaaaggaaaaggacatacattccctgggaaaggccccggtgaggtgctgcctcccggggacagagccgcagccaacagcagccacgggaaggatgtgtccagaccgcctcangccaggaaaactgggggcagctcccccgagaccaagtatgaccagccccctaagtgtgacatctcaggcaaggaggccatctctgccctgtcccgtgctaagtccaagcactgccgccaggagattggggagacttactgccgccacaagttagggctgctgatgcctgagaaggtgactcggttctgccccctcgagggtaaagccaacaagaacgtgcagtgggacgaggactccgtggagtacatgccagccaacccggtcagaatcgcctttgtcctggtggtccacggccgtgcctctcggcagttgcagcgcatgttcaaggccatctaccacaaagaccacttctactacatccacgtggacaagcgctctaattacctgcatcggcaagtgctccaggtctccaggcagtacagcaatgtccgcgtcaccccctggagaatggccaccatctggggaggagccagcctcctgtccacctacctgcagagcatgcgggacctcctggagatgaccgactggccctgggacttcttcatcaacctgagtgcggccgactaccccatcaggacaaatgaccagttggtggcgtttctctcccgataccgagatatgaatttcttgaagtcacacggccgggacaatgcaaggttcattcggaagcagggcctggatcggctcttcctggagtgcgacgctcacatgtggcgcctgggagatcggcggatcccagagggcattgccgtggatggcggttcggactggttcctgctgaaccggaggtttgtagaatatgtgaccttctccacagacgatctggtgaccaagatgaaacagttctactcctacaccctgcttcctgctgagtccttcttccatacggtcctggagaacagcccccactgcgacaccatggtggacaacaacctgcgcatcaccaactggaatcgcaagctgggctgcaagtgccagtacaagcacatcgtggactggtgcggctgctcccccaatgacttcaagccgcaggacttccaccgcttccagcagacagcccggcctaccttctttgcccgcaagtttgaagccgtggtgaatcaggaaatcattgggcagctggactattacctgtacgggaactaccctgcaggtaccccgggcctgcgctcctactgggagaatgtctacgatgagcctgacggcatccacagcctgagcgacgtgacactcaccttgtaccactcctttgcccgcctgggtcttcgacgggccgagacgtccctgcacacggatggggagaacagctgccgatactacccaatgggccacccagcatctgtgcacctctacttccttgctgaccgcttccagggctttctgatcaagcatcatgctaccaatctggctgtgagcaaactagagactctggagacctgggtgatgccgaaaaaagtcttcaagatcgcaagcccacccagtgactttgggaggcttcagttttccgaggtcggcactgactgggatgccaaggagaggctattccgcaactttgggggtcttctggggcccatggatgagccggtgggtatgcagaagtgggggaagggacctaatgtgaccgtgaccgtcatttgggtggatcccgtcaatgtcatcgcagccacctacgacatcctcattgagtccactgccgaattcacacactacaagccccctttgaacttgcccctgaggcctggggtctggacagtgaaaattctccaccactgggtgccagttgcagagaccaaattcctcgttgcgcctctgaccttctcgaacaggcagcccatcaaacctgaggaggcactgaagctgcacaatgggcccctccgcaatgcctacatggagcagagcttccagagcctaaaccccgtcctcagcctgcccatcaaccccgcccaggtggaacaggcacggaggaacgcagcctccacgggcacagcgctggagggatggctggactcgttggtgggcgggatgtggactgccatggacatctgtgccacgggccccacagcctgcccggtcatgcagacctgcagccagacggcctggagctccttcagccctgaccccaagtcggagctgggggcagtcaaacctgatggccggctcaggtagcactgggcacgaggagtgggccacagcaggatctcaacgggaaagcagccagaggggttgtggggcctgaaccccggcctcccaccctgggggaggccctctgtgaatgggtctctcctggccatagaatgatggaaagggaaggtcagcaggtcaaagcaggatcagccaacaacctgcctttggcaagctgcgggtgggatggctcagtccctgcactgtgactgtctcacctcttctggttgatcctcaagtcctacaggttccttgtcttccccttccagtgacccacccctgaccccagacgtgtgattttcagacttttctttcgagcagcagaacttcgtttacggagcacagtcataagtggaggttcagggtgctgacgaaatccaagctgctctggttgaagctgacaagtgcgaggttccctcccaaagctcagccctctgggcggtccccttgcccagggtatctcctacggtacctcttcagaacccaagggctctgcaaatgccagtttgacaagcactgcccagaccaaccatgggttcaaactccagccctgccctttggttcatttttctgcttctcttggctgggggactctggtgccagccttgaaagtcatggtcgtgggccctttcccatggaggctgcagccttaggagagctctgagcctctcagcagccctccttgggttgaactattctccttagtaactaggtaagtgggaaagccttttgatgtggcatggccaaggtccagccacaagtgcaactgccacctgtccaggggtctgggcctccttccctcaaggctgccacacaaagtagcagaaataggatgatgtttgtgagcaccagactcaagaccatgaccttctttgatccttgaaaatgggaactttgacagccatgaccatgaaactcacaaggcaacgcgatgaaactcacaaagcaatgcttggagcaaaactcctgagctagacagcacagcagcacccatcccctgccagagcccttccgttctgaggtcagacacacaaaaccttcgtcaattgcacaccggtgctgttgggagtgaccaaaccacatgaaccagacttttcccgtccaggaaatagcatttcagatttggtttttaatttcatgcccttcggccacaggctcaacgggacatgcaacataaaaatgggaaggttatttaaacaacaaaaaacagtatgatttaagtgttgagttaccagaaacccaaaaggtttccttgccacgagccccctggagtgtcatccctgtt

SEQ ID NO: 290444 - DNA, 2770 bp, Homo sapiens
tgccctagatgagtggcatgtgacctgtacctaaatgatgtctgagatccatcccagctattaccatctaaaattatttagtttatttaacagacatctaaatgatgcttactaagaaatgatgcttactaagtgcctatcattgctttagatgttctgcacacgattaactcacacccttattataacccattttacagatgttgaaactgagaacacagaggtgcaaaaagtatcggagctaattcgggtccagcagagctttgcttctaaccacaggatatgcccttaggttccccccaacccccagcactcgctgatgtggcttttctatttttaatcccatgagtacagcagacagcccggcctaccttctttgcccgcaagtttgaagccgtggtgaatcaggaaatcattgggcagctggactattacctgtacgggaactaccctgcaggtaccccgggcctgcgctcctactgggagaatgtctacgatgagcctgacggcatccacagcctgagcgacgtgacactcaccttgtaccactcctttgcccgcctgggtcttcgacgggccgagacgtccctgcacacggatggggagaacagctgccgatactacccaatgggccacccagcatctgtgcacctctacttccttgctgaccgcttccagggctttctgatcaagcatcatgctaccaatctggctgtgagcaaactagagactctggagacctgggtgatgccgaaaaaagtcttcaagatcgcaagcccacccagtgactttgggaggcttcagttttccgaggtcggcactgactgggatgccaaggagaggctattccgcaactttgggggtcttctggggcccatggatgagccggtgggtatgcagaagtgggggaagggacctaatgtgaccgtgaccgtcatttgggtggatcccgtcaatgtcatcgcagccacctacgacatcctcattgagtccactgccgaattcacacactacaagccccctttgaacttgcccctgaggcctggggtctggacagtgaaaattctccaccactgggtgccagttgcagagaccaaattcctcgttgcgcctctgaccttctcgaacaggcagcccatcaaacctgaggaggcactgaagctgcacaatgggcccctccgcaatgcctacatggagcagagcttccagagcctaaaccccgtcctcagcctgcccatcaaccccgcccaggtggaacaggcacggaggaacgcagcctccacgggcacagcgctggagggatggctggactcgttggtgggcgggatgtggactgccatggacatctgtgccacgggccccacagcctgcccggtcatgcagacctgcagccagacggcctggagctccttcagccctgaccccaagtcggagctgggggcagtcaaacctgatggccggctcaggtagcactgggcacgaggagtgggccacagcaggatctcaacgggaaagcagccagaggggttgtggggcctgaaccccggcctcccaccctgggggaggccctctgtgaatgggtctctcctggccatagaatgatggaaagggaaggtcagcaggtcaaagcaggatcagccaacaacctgcctttggcaagctgcgggtgggatggctcagtccctgcactgtgactgtctcacctcttctggttgatcctcaagtcctacaggttccttgtcttccccttccagtgacccacccctgaccccagacgtgtgattttcagacttttctttcgagcagcagaacttcgtttacggagcacagtcataagtggaggttcagggtgctgacgaaatccaagctgctctggttgaagctgacaagtgcgaggttccctcccaaagctcagccctctgggcggtccccttgcccagggtatctcctacggtacctcttcagaacccaagggctctgcaaatgccagtttgacaagcactgcccagaccaaccatgggttcaaactccagccctgccctttggttcatttttctgcttctcttggctgggggactctggtgccagccttgaaagtcatggtcgtgggccctttcccatggaggctgcagccttaggagagctctgagcctctcagcagccctccttgggttgaactattctccttagtaactaggtaagtgggaaagccttttgatgtggcatggccaaggtccagccacaagtgcaactgccacctgtccaggggtctgggcctccttccctcaaggctgccacacaaagtagcagaaataggatgatgtttgtgagcaccagactcaagaccatgaccttctttgatccttgaaaatgggaactttgacagccatgaccatgaaactcacaaggcaacgcgatgaaactcacaaagcaatgcttggagcaaaactcctgagctagacagcacagcagcacccatcccctgccagagcccttccgttctgaggtcagacacacaaaaccttcgtcaattgcacaccggtgctgttgggagtgaccaaaccacatgaaccagacttttcccgtccaggaaatagcatttcagatttggtttttaatttcatgcccttcggccacaggctcaacgggacatgcaacataaaaatgggaaggttatttaaacaacaaaaaacagtatgatttaagtgttgagttaccagaaacccaaaaggtttccttgccacgagccccctggagtgtcatccctgtt

SEQ ID NO: 290445 - DNA, 1866 bp, Homo sapiens
  misc_feature (1)..(1): n is a, c, g, or t
  misc_feature (93)..(93): n is a, c, g, or t
  misc_feature (318)..(318): n is a, c, g, or t
nctcaggatggctacttttctcatcggccgaaagagaaagtgcgaacagacagcaacaacgagaactctgtccccaaagactttgagaatgtngacaacagcaacttcgcacccaggactcaaaagcagaagcaccagcctgagttggcgaagaagccaccgagtagacagaaggagcttttgaaaaggaagctggaacagcaggagaaaggaaaaggacatacattccctgggaaaggccccggtgaggtgctgcctcccggggacagagccgcagccaacagcagccacgggaaggatgtgtccagaccgcctcangccaggaaaactgggggcagctcccccgagaccaagtatgaccagccccctaagtgtgacatctcaggcaaggaggccatctctgccctgtcccgtgctaagtccaagcactgccgccaggagattggggagacttactgccgccacaagttagggctgctgatgcctgagaaggtgactcggttctgccccctcgagggtaaagccaacaagaacgtgcagtgggacgaggactccgtggagtacatgccagccaacccggtcagaatcgcctttgtcctggtggtccacggccgtgcctctcggcagttgcagcgcatgttcaaggccatctaccacaaagaccacttctactacatccacgtggacaagcgctctaattacctgcatcggcaagtgctccaggtctccaggcagtacagcaatgtccgcgtcaccccctggagaatggccaccatctggggaggagccagcctcctgtccacctacctgcagagcatgcgggacctcctggagatgaccgactggccctgggacttcttcatcaacctgagtgcggccgactaccccatcaggacaaatgaccagttggtggcgtttctctcccgataccgagatatgaatttcttgaagtcacacggccgggacaatgcaaggttcattcggaagcagggcctggatcggctcttcctggagtgcgacgctcacatgtggcgcctgggagatcggcggatcccagagggcattgccgtggatggcggttcggactggttcctgctgaaccggaggtttgtagaatatgtgaccttctccacagacgatctggtgaccaagatgaaacagttctactcctacaccctgcttcctgctgagtccttcttccatacggtcctggagaacagcccccactgcgacaccatggtggacaacaacctgcgcatcaccaactggaatcgcaagctgggctgcaagtgccagtacaagcacatcgtggactggtgcggctgctcccccaatgacttcaagccgcaggacttccaccgcttccaggtgagactttctcatggtctgccagcctcctaagtgatgccttcccaacaaacctctgcagaaatccaaggccagacctgcaggtcatcttatcacatggtgcccaaacctggctgttgataataatagttaacagtatcaacaatagccagtgtttattgagcacttacttcagggatgttctaaccacattgactcattaacccaaaaacaacaaatgacctttcattattattccattttagggatatgaaaactgtgaggcacagaaaggttaaaaaaaactttccaaaggccatactcatatcatcttctctttattcccttttcatcagaatctcccaaaatatttgttacatttgtacccaggaatatgcttttaagtatatatctagggctgagcttttcaacctcagaactcttgccattgtggctggatgattctctgttgggacatgctgtcccatgcatgggtaggatgcttagcagcacctctgg

SEQ ID NO: 290446 - DNA, 945 bp, Homo sapiens
ttctcctgttgctcggagttactcctgctgctgaaatccaagctgctctggttgaagctgacaagtgcgaggttccctcccaaagctcagccctctgggcggtccccttgcccagggtatctcctacggtacctcttcagaacccaagggctctgcaaatgccagtttgacaagcactgcccagaccaaccatgggttcaaactccagccctgccctttggttcatttttctgcttctcttggctgggggactctggtgccagccttgaaagtcatggtcgtgggccctttcccatggaggctgcagccttaggagagctctgagcctctcagcagccctccttgggttgaactattctccttagtaactaggtaagtgggaaagccttttgatgtggcatggccaaggtccagccacaagtgcaactgccacctgtccaggggtctgggcctccttccctcaaggctgccacacaaagtagcagaaataggatgatgtttgtgagcaccagactcaagaccatgaccttctttgatccttgaaaatgggaactttgacagccatgaccatgaaactcacaaggcaacgcgatgaaactcacaaagcaatgcttggagcaaaactcctgagctagacagcacagcagcacccatcccctgccagagcccttccgttctgaggtcagacacacaaaaccttcgtcaattgcacaccggtgctgttgggagtgaccaaaccacatgaaccagacttttcccgtccaggaaatagcatttcagatttggtttttaatttcatgcccttcggccacaggctcaacgggacatgcaacataaaaatgggaaggttatttaaacaacaaaaaacagtatgatttaagtgttgagttaccagaaacccaaaaggtttccttgccacgagccccctggagtgtcatccctgtt

SEQ ID NO: 290447 - DNA, 2368 bp, Homo sapiens
  misc_feature (4)..(4): n is a, c, g, or t
  misc_feature (6)..(8): n is a, c, g, or t
ggcncnnngtttccccgcccctcgcctcggccctttctcttcccagcacctcggctgttccccggcggcggcagcggcagcggcggcccacacagcagcgagaggcgagaggaggctgcctcgaggatgaagtgcaaacccaaccagacgcggacctacgaccccgaggggttcaagaagcgggcggcgtgcctgtgcttccggagcgaacgcgaggacgaggtcctgttagtgagtagcagccggtacccggaccgctggatcgtgccgggcgggggcatggagcccgaggaggagccgggcggtgcggcggtccgagaggtgtacgaagaagcgggagtcaaggggaagttaggccggctcctgggcgtcttcgaacagaaccaggatcgcaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctaatgaacagcaaagatgttcagtattgtgctgaaagaaacattgatgtgaacccagtgatcagtggaattgtcaagtacaggtgagcacttctgtgttcccaagaagacagctcatctggtttcttcctgcatcttgggacactccttccctgtctataccactgactcttgctctggttgttgtactcttatacgtgaatagactcttaattcagcacctatagccttttgttgtgcttttttgatgtgtctgccttcattagactatgatgtctttgagagcaaagactatttttccttactctttgcatattctgcatctgagacactacttgaaatatggttggcatcactgaaggttctttgattcaattaatattttgtaatcaccgtgtggcaaaacattccccttccaatctggtgctagtagagtatatgctatctaggcaccatgtgtgtggcttttgtgtatcaggtgtttcagaaatatttcaagacagttgtaagatgtttgaggacaagaattattactcctatttctatgtcataccacacagtagctgcacagttttaagattatgccatcacctagggtaatgttttgtagaatcagtccttcgtgtaacaactctagtgtttttgtactgttgatgatttgcttaaattttattcaaaaactatcacttgctataaaggtaattgtaaaaataaatacagtggacgcaaaataatgttgtgagtttttataaaaataaattttaaaatgatatataagacatttttttgcaatgcctgccctaaccacttcttacatgtcatcttaacatctctttgaggaaacactgtttcctcattttacagatttaacatactgtattatttgatgccagagccaacaggctatatcataggcagtttccaaacttaattatgccatttagtttgtctagatttcttttgcctctctcactgatccatttggctgtagttttcatcccttttccagtacacacagctagctcctcatcctacctggtttctgcatatgagaatgcagagggctgagagagggcaaaattgttgtcatttagaaaaggcatttaggaaagaggctgctattagaggggaacacaaagtgaaggtttttttaaaaaagaggacttgcatcagctgcctccagaacaattttaagaaaataacaaagatgtttagaagaaatcttacggagtttgccatgggatgtgtgatatcagcagtcttcagctccttacaaattaccaaaagtggttctaatatgctagtttgtttgattttttcttttatattataaagcaattgcatcgataaaagcttggactccattttagtgtgacactcttcctcatgataccagtgaaatgtattgattgtgtccccagttgttacataatttgaaataaaaatataacttcttgatttattgttttttaagatgtgatatggtactgtggttatgttgttttaaaaaatgattatcttttagagaagtatactgaaaaatgtacaggtgaaatgatatgttactggtattcgcttcaaaatcatctgagtgtggggtaattgagtacatagatgaaacaagattggccataaattggtaattgctgaagctgtgtgatggatgtttgagagttcattatactattctctatacttttgtatatgtttgaaattttccataataaaaattgaaaaaagtaaaaaaaaaa

SEQ ID NO: 290448 - DNA, 1300 bp, Homo sapiens
  misc_feature (9)..(9): n is a, c, g, or t
cttgatccnagggcgcccctgacctttgagccggctcgggttccggctctggcgcgtgcacactcgcctcgccgttcgggaccagccagatcgcggcggcctcgcgggcggtctggtcggtgaggtcttggccgcgcgcggcaatgctgaggctgctggcgtccgggtgcgcccggggcccggggcccggcgtgggcgcgcgtcctgccgcagggctctttcatccggggcgccgccagagccgccaggcttccgatgcgccccggaaccagccccccagccccgagttcgtggcccggccggtgggcgtctgctccatgatgcgcctgccggtgcagacctcccccgaggggctggacgctgccttcatcggggtgcccctggatactgggacctccaaccggcctggggcgagattcggacctcgccgcatccgggaagaatcagtgatgcttcggacagtcaatcctagcacgggggccctccccttccagtccctcatggttgcagacctaggcgatgtgaatgtcaatctttacaaccttcaggacagctgccggcgaattcaagaggcctatgagaaaattgtagcagctggctgtattcctctgaccttgggtggagatcacacaatcacatatcccatattgcaagcgatggcaaaaaagcatggcccagtggggctgctgcacgtggatgcgcacacggacacgaccgacaaggccctaggagagaagctctaccacggggcgcccttccgccggtgtgtggatgagggtctcctggactgtaagcgtgtggtgcagattggcatccggggctcttccacgaccttggatccctacagatacaaccggagccagggcttccgggtagtcctggctgaagactgctggatgaagtcgctggttcctctgatgggggaagtcaggcagcagatgggaggcaaacccatttatatcagctttgatattgacgctctggatcctgcctatgcgccagggacagggacacctgaaattgctggtctcactcctagtcaggctctggagatcatcaggggttgtcaaggcctgaacgtgatgggctgtgatcttgtcgaagtttcaccaccgtatgatctttctgggaacacagccctgctggcggctaacctgctgtttgagatgctatgtgctctccccaaagtgacaaccgtctgagtcttgtgctcttcaagacaaaacagattgcgtcgctgacaagttctcaagaagaacttatgagtaagcagtctgagaactaaagagtttatgccaag

SEQ ID NO: 290449 - DNA, 1709 bp, Homo sapiens
  misc_feature (9)..(9): n is a, c, g, or t
cttgatccnagggcgcccctgacctttgagccggctcgggttccggctctggcgcgtgcacactcgcctcgccgttcgggaccagccagatcgcggcggcctcgcgggcggtctggtcggtgaggtcttggccgcgcgcggcaatgctgaggctgctggcgtccgggtgcgcccggggcccggggcccggcgtgggcgcgcgtcctgccgcagggctctttcatccggggcgccgccagagccgccaggcttccgatgcgccccggaaccagccccccagccccgagttcgtggcccggccggtgggcgtctgctccatgatgcgcctgccggtgcagacctcccccgaggggctggacgctgccttcatcggggtgcccctggatactgggacctccaaccggcctggggcgagattcggacctcgccgcatccgggaagaatcagtgatgcttcggacagtcaatcctagcacgggggccctccccttccagtccctcatggttgcagacctaggcgatgtgaatgtcaatctttacaaccttcaggacagctgccggcgaattcaagaggcctatgagaaaattgtagcagctggctgtattcctctgaccttgggtggagatcacacaatcacatatcccatattgcaagcgatggcaaaaaagcatggcccagtggggctgctgcacgtggatgcgcacacggacacgaccgacaaggccctaggagagaagctctaccacggggcgcccttccgccggtgtgtggatgagggtctcctggactgtaagcgtgtggtgcagattggcatccggggctcttccacgaccttggatccctacagatacaaccggagccagggcttccgggtagtcctggctgaagactgctggatgaagtcgctggttcctctgatgggggaagtcaggcagcagatgggaggcaaacccatttatatcagctttgatattgacgctctggatcctgcctatgcgccagggacagggacacctgaaattgctggtctcactcctagtcaggctctggagatcatcaggggttgtcaaggcctgaacgtgatgggctgtgatcttgtcgaagtttcaccaccgtatgatctttctgggaacacagccctgctggcggctaacctgctgtttgagatgctatgtgctctccccaaagtgacaaccgtctgagtcttgtgctcttcaagacaaaacagattgcgtcgctgacaagttctcaagaagaacttatgagtaagcagtctgagaactaaagagtttatgccaagaaaactttctgctgaaagtgtcattgctggctgtgaagtcgggataatcagtagaattctcacccaaacagcaacatttctaaggaacttggattaattgggggaaaaaaaaaggagtacttgtactgctttgattttttttcctttgatgaaagatggaggataaaggggaagtgaggagaatttctttcaagattatctaaacattagaaacatgacatttaaaaaaactatgaaataatactgtataagcattccatctcaaaaaaaaaaaaaaaaaatacagcttctcctatgaggtgcttagggctgcatcttggttttaggacccctgtgaacgtaagtaaaaagtataaagtaacacggagagcctgggtgacagagtgagactccgtctccaaaaaaaaaa

SEQ ID NO: 290450 - DNA, 567 bp, Homo sapiens
  misc_feature (3)..(3): n is a, c, g, or t
  misc_feature (5)..(5): n is a, c, g, or t
tgngntagagttttgcttgtcacccaggctggagtgcaatggcatgatctcggttcattgcaacctccgcctcccgagttcaatcgattctcctgcctcagcctcctgagtacctgggattacaggtgcctgccaccacgcctggctaatttttgtatttttagtagagacagggtttcaccacattggccaggctggtcttgaactcctgacctaaggtgatccgcccgcctcagcctccttaaagtgctgggattacaggcatgagccaccgcacccagccgctttttaaaattttgatgatctgcttcctagagtattgagtatcttcctttaaactacagctcctcctcggacgctgcagtgagctgagatcgcaccactgcactccagcctgggtgccagagcaggactccatctcaaaaaaaaaaaaaaaaaatacagcttctcctatgaggtgcttagggctgcatcttggttttaggacccctgtgaacgtaagtaaaaagtataaagtaacacggagagcctgggtgacagagtgagactccgtctccaaaaaaaaaa

SEQ ID NO: 290451 - DNA, 385 bp, Homo sapiens
agcttctcctatgaggtgcttagggctgcatcttggttttaggaccactgtgaacgtaagtaaaaagtataaagtaacccggagagccaccgcgcccagccgctttttaaaattttgatgatctgcttcctagagtattgagtatcttcctttaaactacagctcctcctcggacgctgcagtgagctgagatcgcaccactgcactccagcctgggtgccagagcaggactccatctcaaaaaaaaaaaaaaaaaatacagcttctcctatgaggtgcttagggctgcatcttggttttaggacccctgtgaacgtaagtaaaaagtataaagtaacacggagagcctgggtgacagagtgagactccgtctccaaaaaaaaaa

SEQ ID NO: 290452 - DNA, 393 bp, Homo sapiens
ttttttgagatggagtctcgctctgtcgctcaggctagagtacagtggcgcgatcttggctcactgcgacctccacctcctgggttcaagcgattctcctgccccagccgctttttaaaattttgatgatctgcttcctagagtattgagtatcttcctttaaactacagctcctcctcggacgctgcagtgagctgagatcgcaccactgcactccagcctgggtgccagagcaggactccatctcaaaaaaaaaaaaaaaaaatacagcttctcctatgaggtgcttagggctgcatcttggttttaggacccctgtgaacgtaagtaaaaagtataaagtaacacggagagcctgggtgacagagtgagactccgtctccaaaaaaaaaa

SEQ ID NO: 290453 - DNA, 891 bp, Homo sapiens
ggttgaaaagggagtacccatctgatatctaggcagcatgaattggcctttggttccctgccacccgacccttttctcctgcctcttactgctctagtgataccacttatgctattgtctatggcaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttggaagaaaatatttttaaatggacaatggactgtacaataagttacttgaaataagttgtttcagataaatttcaattagatttaaaataaacattatgtccaccttttaagttaatgaaataaaatttgaaactga

SEQ ID NO: 290454 - DNA, 912 bp, Homo sapiens
agcgggggcggaaaagcgggctgtctcggaaactcagagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttggaagaaaatatttttaaatggacaatggactgtacaataagttacttgaaataagttgtttcagataaatttcaattagatttaaaataaacattatgtccaccttttaagttaatgaaataaaatttgaaactga

SEQ ID NO: 290455 - DNA, 1399 bp, Homo sapiens
agcgggggcggaaaagcgggctgtctcggaaactcagagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttggaagaaaatatttttaaatggacaatggactgtacaataagttacttgaaataagttgtttcagataaatttcaattagatttaaaataaacattatgtccaccttttaagttaatgaaataaaatttgaaactgacaattgcagcttttgcttatatactaatgctaggagaggagggataattaagaataaaatatgtagtgaaagtttccatagtgtgaggctaaaactagaagaaactgtggtaggtccttttgtgggtgggggacaggggagtctgtaaaaagccagtctgtagatgatattttaatatattattgtaatcgaatcgttcagttgttttttgacatggaaagtcctggattttaagctttaaatttgcttattttgtaggtttaagaacatgattttcatgggagttgtaaaattaactgtgctttagcaccttgaggtacactttccttcaacaaatgaaattggattggtgctccagaatttcagagcggtttctgaaagtagtgattttgagctatcccaattcctgttcttcctgaggcctggtttagctcttccttgaattctgcaagctatctcatattttcagtaaattccatttttttta

SEQ ID NO: 290456 - DNA, 797 bp, Homo sapiens
agcgggggcggaaaagcgggctgtctcggaaactcagagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgtaagtcagtaatgttgtatgcagcagaaatgatacctaaactaaaaacaaggacacaaaaaacaggaggtgctgaccaaagtcttcaacaaggagagggaagtaaaacaaccaaaaaaaaaaaaagccgagactagtgctctctctcccggcagctcgagtccaccaggagcgccgtccgtggaccgagatgctgcgggcctgaccagcatcgggggtagaccgccgccgcccagagtggtcctctgggggcaagctgggcctccgtccatggcggaccatgccgcaagatactctactacaggcaggccgggtgacaccgggccaccatggttggagtggacatctagcacggcggcgaggcatggcggcgcacaacccaacatgga

SEQ ID NO: 290457 - DNA, 825 bp, Homo sapiens
  misc_feature (824)..(824): n is a, c, g, or t
agcgggggcggaaaagcgggctgtctcggaaactcagagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacattatacactaagcctaacttctggttccgtaagtcagtaatgttgtatgcagcagaaatgatacctaaactaaaaacaaggacacaaaaaacaggaggtgctgaccaaagtcttcaacaaggagagggaagtaaaaaaaaaaaaaaacaaaaaaaaacaatttgtggcgccggcctcggagcccgaagaaaggttttctacaaaccccttcgcttgtggcggcggcggcccgagagggaattacaaccttggccataacgctgcttcaaaggaaacccttgcccacagccagtgggtgtgggttcccacccattaaaaaaccgcggcgggacccgggcgttctgaccaaccaaatgcgtccgggccaccggtctcacaacgggtcaggagcatgagtcccgcgccccgggggggnc

SEQ ID NO: 290458 - DNA, 1364 bp, Homo sapiens
tcttgggctcaagcaaccctcctgcctcagcctcccaagtagctgggaatatcggcacatgattttttattttttctagagatggggttttgctatgtttcctaagccagtctcaaactcgtggacacaagtgatcctcctgcctcagcctcccaaagagctgagattacagacatgacccactgggctcagcctaaaatagattgttttttatatactaaaacccatcaggattggtaggtattgctagatgcttcaggttgtgactaaggagtgacatcatattctgatatgttttttctccttaacattttcctatattatatctcaaaagaccaaaaacaaacaaaaacttgtaattaactagtagataaaataggggtagaagttgtggtgagaacatgtcacttcctatttccagtaagacccaagtaagatagtaaaaagaaagcagagctgaggaacttggtctgttgggggtgaaggtagctggttgtaggtgtgcagagcaggaatgcatgtaagtgtagatcatctgatcttacccatcggatcgcttgtaacttgatgatactgtttttttgttgtaagactgagaaaaccctgtatttcagtgtcttaagatacagtgatattctgactctgtttctacctgaggtatatttggatacatactccttagatcttcaagctgattactaggaccaaaccaaaatttttgtttcatacttagtgttttgccttttgattttattcatttaaatattttcagcattattctcactctcagtacatttcccccgacttgagctagtcagtgtcttcagtcatttgatttttgattttttaaaaaagttattttccattttcttgatgtgatagtttcttacactttgtgatattcaatttgatgactttttatgtcttatttctcagattatacactaagcctaacttctggttccgtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaaaaaaaaccccaccacctataagtaaaataatagggcggggggtagggggggggaaacacaca

SEQ ID NO: 290459 - DNA, 886 bp, Homo sapiens
agcgggggcggaaaagcgggctgtctcggaaactcagagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgaggtatgacgtggttcttcactattttccatactcatctaattgatgtaataactttcttaagtcctgtttttcttttgtttcgtttatgttagaaaaataaaatgtactctagagaatggaatcgtgatgtccaatacagaggcagagtccgggtccagctcaaacaggaagatgggagcctctgccttgtacagttcccatcacgtaagcttgtttaaatgaatcagtggggctcagggataggtttctcctacacaacacaaaaaaggttctaaaactgaaaggtaaaagtcagaatttgcattctgaagattaatttaaagacaggactactgctcatggagagaagcagtagttctaatttctttgaggtgaatgacctctttgaaaatgtaatgagacccactaaacatttttcaaaaaaattgttgtgtgaacattttataaacctctggaagtctgtcattgctcccaggttaagaatataaaattattaaatcgttggatgttaattgccatttcagatcctagaggtccttgaggtctgttaatatctataatatctaatgattctatcattaataaatctg

SEQ ID NO: 290460 - DNA, 1019 bp, Homo sapiens
tgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaagatggctctacaaaaacaattccatggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttggaagaaaatatttttaaatggacaatggactgtacaataagttacttgaaataagttgtttcagataaatttcaattagatttaaaataaacattatgtccaccttttaagttaatgaaataaaatttgaaactga

SEQ ID NO: 290461 - DNA, 941 bp, Homo sapiens
agcgggggcggaaaagcgggctgtctcggaaactcagagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacattatacactaagcctaacttctggttccgtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttggaagaaaatatttttaaatggacaatggactgtacaataagttacttgaaataagttgtttcagataaatttcaattagatttaaaataaacattatgtccaccttttaagttaatgaaataaaatttgaaactga

SEQ ID NO: 290462 - DNA, 1469 bp, Homo sapiens
tcttgggctcaagcaaccctcctgcctcagcctcccaagtagctgggaatatcggcacatgattttttattttttctagagatggggttttgctatgtttcctaagccagtctcaaactcgtggacacaagtgatcctcctgcctcagcctcccaaagagctgagattacagacatgacccactgggctcagcctaaaatagattgttttttatatactaaaacccatcaggattggtaggtattgctagatgcttcaggttgtgactaaggagtgacatcatattctgatatgttttttctccttaacattttcctatattatatctcaaaagaccaaaaacaaacaaaaacttgtaattaactagtagataaaataggggtagaagttgtggtgagaacatgtcacttcctatttccagtaagacccaagtaagatagtaaaaagaaagcagagctgaggaacttggtctgttgggggtgaaggtagctggttgtaggtgtgcagagcaggaatgcatgtaagtgtagatcatctgatcttacccatcggatcgcttgtaacttgatgatactgtttttttgttgtaagactgagaaaaccctgtatttcagtgtcttaagatacagtgatattctgactctgtttctacctgaggtatatttggatacatactccttagatcttcaagctgattactaggaccaaaccaaaatttttgtttcatacttagtgttttgccttttgattttattcatttaaatattttcagcattattctcactctcagtacatttcccccgacttgagctagtcagtgtcttcagtcatttgatttttgattttttaaaaaagttattttccattttcttgatgtgatagtttcttacactttgtgatattcaatttgatgactttttatgtcttatttctcagattatacactaagcctaacttctggttccgtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttggaagaaaatatttttaaatggacaatggactgtacaataagttacttgaaataagttgtttcagataaatttcaattagatttaaaataaacattatgtccaccttttaagttaatgaaataaaatttgaaactga

SEQ ID NO: 290463 - DNA, 581 bp, Homo sapiens
aaaagaagaaaggacaaacaaaaccaacacccaccgcccccccgaacccccacaacactaattaaaacaagaactacgtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttggaagaaaatatttttaaatggacaatggactgtacaataagttacttgaaataagttgtttcagataaatttcaattagatttaaaataaacattatgtccaccttttaagttaatgaaataaaatttgaaactga

SEQ ID NO: 290464 - DNA, 794 bp, Homo sapiens
agcgggggcggaaaagcgggctgtctcggaaactcagagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgtaagcttgtttaaatgaatcagtggggctcagggataggtttctcctacacaacacaaaaaaggttctaaaactgaaaggtaaaagtcagaatttgcattctgaagattaatttaaagacaggactactgctcatggagagaagcagtagttctaatttctttgaggtgaatgacctctttgaaaatgtaatgagacccactaaacatttttcaaaaaaattgttgtgtgaacattttataaacctctggaagtctgtcattgctcccaggttaagaatataaaattattaaatcgttggatgttaattgccatttcagatcctagaggtccttgaggtctgttaatatctataatatctaatgattctatcattaataaatctg

SEQ ID NO: 290465 - DNA, 421 bp, Homo sapiens
ttttttttttgagacagggtcttgctctgttgctcaggctggagtgcagtggcatgatcacagctcaacgcagcctcaatctgctgggctcaagcaatcctcccacttcagcctcctgagtaactgggactacaggcacacaccaccacgaccagccaatatttttattttttgtcgagatggggtctcctatgttgtccaggctagtcttgaattcctgggctcaagtgaacctcccattttggcctcccaaaatgtgggcaatcaaatattttgttgtatccaaggtgagcaggggggtagggagagggagagggagagagagggagacagagggagacagagggagagagagggagacagagggagacagagggagagagaggggaagagacagagggagacagagggagagaacaca

SEQ ID NO: 290466 - DNA, 1970 bp, Homo sapiens
ccatcctattacgactcactatagggctcgagcggccgcccgggcagtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattct

SEQ ID NO: 290467 - DNA, 672 bp, Homo sapiens
gaacatacacagggggttggtgaatggtgccgaccgcggccatcgcagttggaggctattttttggggggggtgagtagcgtccatggagttactttgcgcccactcctagcggcaccggcttaggtcctgcgggccgaccgtccccggcggggggcgtggggcctgggacgccgcgggcccggcgcctccctcgccgcgacccggatggatgcgcgccccccgccctcccgcgccggccccaggagctcccggcttcgggagcatccttcccgcgccggtccctgcagcggcgcgtagccgagggcagcgcccgtcaggggggcaccgcggagcaagatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatgagccaggcagcccaggcta

SEQ ID NO: 290468 - DNA, 6627 bp, Homo sapiens
gaacatacacagggggttggtgaatggtgccgaccgcggccatcgcagttggaggctattttttggggggggtgagtagcgtccatggagttactttgcgcccactcctagcggcaccggcttaggtcctgcgggccgaccgtccccggcggggggcgtggggcctgggacgccgcgggcccggcgcctccctcgccgcgacccggatggatgcgcgccccccgccctcccgcgccggccccaggagctcccggcttcgggagcatccttcccgcgccggtccctgcagcggcgcgtagccgagggcagcgcccgtcaggggggcaccgcggagcaagatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattctacactgttgtctttcctctgtgctggcctaggacattaggattccttccacggctccggccgctaggaccctgccaggtcccgcgcaccatccctgccctgcccacgtggtattgctgggctcctggctagatgcaagcaaggtggacaagagctcaggactccagcccactgccactgggtgacacagactgtcgtttgggcattatttcatggcagatgggccagtccagggcctaccccgccttgcccccagatcccactggggtccatttggggggtcctgctacactccaccgatccccaaggaagtataataaacgatacccagccagagtctactcactgtcacaagcacaacgagtttatatgagaaagcactgagggggtgcagagggcccgctagttccaggggaactgaaagctgttcctgatcagcccgtatcatctgaggcctgcctgcccaccctgccaccctcccctcccttgctgctctgcccctgccagtgcccagcccagcggctctgggaaggggttcccagaatccctcctgagctgtgccatttactcaggggactcccaaacagccagctgccagtgcaggtggagggctgtaggggagggccagtgcccagacagggtcatggggctcagaccagcccactgtagagaatcactctgaggctccaacttccttccttccttcggggccagtctcggccgaagtctggtcacgctcagacagagctgaccagaccagaccgtttgccttttcaagtttcctagtcctgctacaagatgagcttcttccgtggtttccttttggaaactcctccttccaacaagcagtgggatcccggggcccagggcgggccggtgttggccgctggggctgttgtaagtcttgctggatgttcccctgttcctgagccttaacccctcgcacagccatcccccccccccgtcctgccatccccccccgccgtcctgccttccccaccccacccttaggtcccaggtagttgctctgaagagtttcagtagagtggccccagggtgatagctcagggaacaacaaaaaaggaattccgtgaaaacatttttttttctttgatgaattactcctgggtcacttccaccactggtaaagccagaacttctccaaaaagaaccttgcaaaaagtccagtgaatcagtcgaatcattctgtggatgccaaagaatattttgaccataatacagcacagcctggacctgacaacttgtcatttggacttttttttaaatggagttctttagcaacaaagtatagaaacatgttcattgcacacacccaaggagaagagctcaagcgcttggaagaggatgctttgctgctgctgaagtgtacctgggtgttagatttcagatcctgggctgagcccactgtgagctttcctaaactgtgagactcacagaggggaaagatactgacggtgaaaccagcatggaaaacgtctttaccatgtggttccctcctccccaaatacataaagcaaataagcaggatggggaacagcttgaccttcatccacccctaactccaaaactatcaaggtacgacagtggcattgtcatcgacactcaatttcatgtgaattttagcaaaacaggaaacaaagataatgactcagttcagaggatcggacaaatgtgtctagtccgggtggactcggagggagtggggtgggcttcaaggattctgggcgttgggatggcatgagctaccctgtagagtttagtctgcctgcccgccttggtagtagtgaccagtcagtgtcagcatcagtgtcccaaccccagtctctgtttactgcctttgaacagaacttcttccttccccatgctttgggtcacctcgggctgcaaccctgtctgtgccagattgcccggtctgaccctgcaggaagcaaagaggtgagcttaaagaacaaccaaactctgccaggggtcccagaaagcccagggtccagcagtctcagcacttggccccttgccccttcacaccatcctggggcaggggctgggcctccctggtggcaggggtgggtggagaattagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgtgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcaatgttttctgtg

SEQ ID NO: 290469 - DNA, 6368 bp, Homo sapiens
ggggcgacgaaaatgattattagtcgataccggttgttatttcagtcacgtggctcgtagcggcacctgtaggaacatgatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattctacactgttgtctttcctctgtgctggcctaggacattaggattccttccacggctccggccgctaggaccctgccaggtcccgcgcaccatccctgccctgcccacgtggtattgctgggctcctggctagatgcaagcaaggtggacaagagctcaggactccagcccactgccactgggtgacacagactgtcgtttgggcattatttcatggcagatgggccagtccagggcctaccccgccttgcccccagatcccactggggtccatttggggggtcctgctacactccaccgatccccaaggaagtataataaacgatacccagccagagtctactcactgtcacaagcacaacgagtttatatgagaaagcactgagggggtgcagagggcccgctagttccaggggaactgaaagctgttcctgatcagcccgtatcatctgaggcctgcctgcccaccctgccaccctcccctcccttgctgctctgcccctgccagtgcccagcccagcggctctgggaaggggttcccagaatccctcctgagctgtgccatttactcaggggactcccaaacagccagctgccagtgcaggtggagggctgtaggggagggccagtgcccagacagggtcatggggctcagaccagcccactgtagagaatcactctgaggctccaacttccttccttccttcggggccagtctcggccgaagtctggtcacgctcagacagagctgaccagaccagaccgtttgccttttcaagtttcctagtcctgctacaagatgagcttcttccgtggtttccttttggaaactcctccttccaacaagcagtgggatcccggggcccagggcgggccggtgttggccgctggggctgttgtaagtcttgctggatgttcccctgttcctgagccttaacccctcgcacagccatcccccccccccgtcctgccatccccccccgccgtcctgccttccccaccccacccttaggtcccaggtagttgctctgaagagtttcagtagagtggccccagggtgatagctcagggaacaacaaaaaaggaattccgtgaaaacatttttttttctttgatgaattactcctgggtcacttccaccactggtaaagccagaacttctccaaaaagaaccttgcaaaaagtccagtgaatcagtcgaatcattctgtggatgccaaagaatattttgaccataatacagcacagcctggacctgacaacttgtcatttggacttttttttaaatggagttctttagcaacaaagtatagaaacatgttcattgcacacacccaaggagaagagctcaagcgcttggaagaggatgctttgctgctgctgaagtgtacctgggtgttagatttcagatcctgggctgagcccactgtgagctttcctaaactgtgagactcacagaggggaaagatactgacggtgaaaccagcatggaaaacgtctttaccatgtggttccctcctccccaaatacataaagcaaataagcaggatggggaacagcttgaccttcatccacccctaactccaaaactatcaaggtacgacagtggcattgtcatcgacactcaatttcatgtgaattttagcaaaacaggaaacaaagataatgactcagttcagaggatcggacaaatgtgtctagtccgggtggactcggagggagtggggtgggcttcaaggattctgggcgttgggatggcatgagctaccctgtagagtttagtctgcctgcccgccttggtagtagtgaccagtcagtgtcagcatcagtgtcccaaccccagtctctgtttactgcctttgaacagaacttcttccttccccatgctttgggtcacctcgggctgcaaccctgtctgtgccagattgcccggtctgaccctgcaggaagcaaagaggtgagcttaaagaacaaccaaactctgccaggggtcccagaaagcccagggtccagcagtctcagcacttggccccttgccccttcacaccatcctggggcaggggctgggcctccctggtggcaggggtgggtggagaattagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgtgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcaatgttttctgtg

SEQ ID NO: 290470 - DNA, 6195 bp, Homo sapiens
  misc_feature (33)..(33): n is a, c, g, or t
  misc_feature (47)..(47): n is a, c, g, or t
agtagctgttctatgaggatcccagcatcactngactcgaagacganagaagcctccgagttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattctacactgttgtctttcctctgtgctggcctaggacattaggattccttccacggctccggccgctaggaccctgccaggtcccgcgcaccatccctgccctgcccacgtggtattgctgggctcctggctagatgcaagcaaggtggacaagagctcaggactccagcccactgccactgggtgacacagactgtcgtttgggcattatttcatggcagatgggccagtccagggcctaccccgccttgcccccagatcccactggggtccatttggggggtcctgctacactccaccgatccccaaggaagtataataaacgatacccagccagagtctactcactgtcacaagcacaacgagtttatatgagaaagcactgagggggtgcagagggcccgctagttccaggggaactgaaagctgttcctgatcagcccgtatcatctgaggcctgcctgcccaccctgccaccctcccctcccttgctgctctgcccctgccagtgcccagcccagcggctctgggaaggggttcccagaatccctcctgagctgtgccatttactcaggggactcccaaacagccagctgccagtgcaggtggagggctgtaggggagggccagtgcccagacagggtcatggggctcagaccagcccactgtagagaatcactctgaggctccaacttccttccttccttcggggccagtctcggccgaagtctggtcacgctcagacagagctgaccagaccagaccgtttgccttttcaagtttcctagtcctgctacaagatgagcttcttccgtggtttccttttggaaactcctccttccaacaagcagtgggatcccggggcccagggcgggccggtgttggccgctggggctgttgtaagtcttgctggatgttcccctgttcctgagccttaacccctcgcacagccatcccccccccccgtcctgccatccccccccgccgtcctgccttccccaccccacccttaggtcccaggtagttgctctgaagagtttcagtagagtggccccagggtgatagctcagggaacaacaaaaaaggaattccgtgaaaacatttttttttctttgatgaattactcctgggtcacttccaccactggtaaagccagaacttctccaaaaagaaccttgcaaaaagtccagtgaatcagtcgaatcattctgtggatgccaaagaatattttgaccataatacagcacagcctggacctgacaacttgtcatttggacttttttttaaatggagttctttagcaacaaagtatagaaacatgttcattgcacacacccaaggagaagagctcaagcgcttggaagaggatgctttgctgctgctgaagtgtacctgggtgttagatttcagatcctgggctgagcccactgtgagctttcctaaactgtgagactcacagaggggaaagatactgacggtgaaaccagcatggaaaacgtctttaccatgtggttccctcctccccaaatacataaagcaaataagcaggatggggaacagcttgaccttcatccacccctaactccaaaactatcaaggtacgacagtggcattgtcatcgacactcaatttcatgtgaattttagcaaaacaggaaacaaagataatgactcagttcagaggatcggacaaatgtgtctagtccgggtggactcggagggagtggggtgggcttcaaggattctgggcgttgggatggcatgagctaccctgtagagtttagtctgcctgcccgccttggtagtagtgaccagtcagtgtcagcatcagtgtcccaaccccagtctctgtttactgcctttgaacagaacttcttccttccccatgctttgggtcacctcgggctgcaaccctgtctgtgccagattgcccggtctgaccctgcaggaagcaaagaggtgagcttaaagaacaaccaaactctgccaggggtcccagaaagcccagggtccagcagtctcagcacttggccccttgccccttcacaccatcctggggcaggggctgggcctccctggtggcaggggtgggtggagaattagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgtgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcaatgttttctgtg

SEQ ID NO: 290471 - DNA, 6756 bp, Homo sapiens
gaacatacacagggggttggtgaatggtgccgaccgcggccatcgcagttggaggctattttttggggggggtgagtagcgtccatggagttactttgcgcccactcctagcggcaccggcttaggtcctgcgggccgaccgtccccggcggggggcgtggggcctgggacgccgcgggcccggcgcctccctcgccgcgacccggatggatgcgcgccccccgccctcccgcgccggccccaggagctcccggcttcgggagcatccttcccgcgccggtccctgcagcggcgcgtagccgagggcagcgcccgtcaggggggcaccgcggagcaagatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagagcggtctgggaggagagcaaagggcaagaagagtgactcgaagaggaagggctgcgagggctccaagggcagcactgagaagaaagagaaagtgaaggcggggcctgactcagtcctggggcagctggcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattctacactgttgtctttcctctgtgctggcctaggacattaggattccttccacggctccggccgctaggaccctgccaggtcccgcgcaccatccctgccctgcccacgtggtattgctgggctcctggctagatgcaagcaaggtggacaagagctcaggactccagcccactgccactgggtgacacagactgtcgtttgggcattatttcatggcagatgggccagtccagggcctaccccgccttgcccccagatcccactggggtccatttggggggtcctgctacactccaccgatccccaaggaagtataataaacgatacccagccagagtctactcactgtcacaagcacaacgagtttatatgagaaagcactgagggggtgcagagggcccgctagttccaggggaactgaaagctgttcctgatcagcccgtatcatctgaggcctgcctgcccaccctgccaccctcccctcccttgctgctctgcccctgccagtgcccagcccagcggctctgggaaggggttcccagaatccctcctgagctgtgccatttactcaggggactcccaaacagccagctgccagtgcaggtggagggctgtaggggagggccagtgcccagacagggtcatggggctcagaccagcccactgtagagaatcactctgaggctccaacttccttccttccttcggggccagtctcggccgaagtctggtcacgctcagacagagctgaccagaccagaccgtttgccttttcaagtttcctagtcctgctacaagatgagcttcttccgtggtttccttttggaaactcctccttccaacaagcagtgggatcccggggcccagggcgggccggtgttggccgctggggctgttgtaagtcttgctggatgttcccctgttcctgagccttaacccctcgcacagccatcccccccccccgtcctgccatccccccccgccgtcctgccttccccaccccacccttaggtcccaggtagttgctctgaagagtttcagtagagtggccccagggtgatagctcagggaacaacaaaaaaggaattccgtgaaaacatttttttttctttgatgaattactcctgggtcacttccaccactggtaaagccagaacttctccaaaaagaaccttgcaaaaagtccagtgaatcagtcgaatcattctgtggatgccaaagaatattttgaccataatacagcacagcctggacctgacaacttgtcatttggacttttttttaaatggagttctttagcaacaaagtatagaaacatgttcattgcacacacccaaggagaagagctcaagcgcttggaagaggatgctttgctgctgctgaagtgtacctgggtgttagatttcagatcctgggctgagcccactgtgagctttcctaaactgtgagactcacagaggggaaagatactgacggtgaaaccagcatggaaaacgtctttaccatgtggttccctcctccccaaatacataaagcaaataagcaggatggggaacagcttgaccttcatccacccctaactccaaaactatcaaggtacgacagtggcattgtcatcgacactcaatttcatgtgaattttagcaaaacaggaaacaaagataatgactcagttcagaggatcggacaaatgtgtctagtccgggtggactcggagggagtggggtgggcttcaaggattctgggcgttgggatggcatgagctaccctgtagagtttagtctgcctgcccgccttggtagtagtgaccagtcagtgtcagcatcagtgtcccaaccccagtctctgtttactgcctttgaacagaacttcttccttccccatgctttgggtcacctcgggctgcaaccctgtctgtgccagattgcccggtctgaccctgcaggaagcaaagaggtgagcttaaagaacaaccaaactctgccaggggtcccagaaagcccagggtccagcagtctcagcacttggccccttgccccttcacaccatcctggggcaggggctgggcctccctggtggcaggggtgggtggagaattagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgtgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcaatgttttctgtg

SEQ ID NO: 290472 - DNA, 6371 bp, Homo sapiens
gaacatacacagggggttggtgaatggtgccgaccgcggccatcgcagttggaggctattttttggggggggtgagtagcgtccatggagttactttgcgcccactcctagcggcaccggcttaggtcctgcgggccgaccgtccccggcggggggcgtggggcctgggacgccgcgggcccggcgcctccctcgccgcgacccggatggatgcgcgccccccgccctcccgcgccggccccaggagctcccggcttcgggagcatccttcccgcgccggtccctgcagcggcgcgtagccgagggcagcgcccgtcaggggggcaccgcggagcaagatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgatgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagagcggtctgggaggagagcaaagggcaagaagagtgactcgaagaggaagggctgcgagggctccaagggcagcactgagaagaaagagaaagtgaaggcggggcctgactcagtcctggggcagctggcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattctacactgttgtctttcctctgtgctggcctaggacattaggattccttccacggctccggccgctaggaccctgccaggtcccgcgcaccatccctgccctgcccacgtggtattgctgggctcctggctagatgcaagcaaggtggacaagagctcaggactccagcccactgccactgggtgacacagactgtcgtttgggcattatttcatggcagatgggccagtccagggcctaccccgccttgcccccagatcccactggggtccatttggggggtcctgctacactccaccgatccccaaggaagtataataaacgatacccagccagagtctactcactgtcacaagcacaacgagtttatatgagaaagcactgagggggtgcagagggcccgctagttccaggggaactgaaagctgttcctgatcagcccgtatcatctgaggcctgcctgcccaccctgccaccctcccctcccttgctgctctgcccctgccagtgcccagcccagcggctctgggaaggggttcccagaatccctcctgagctgtgccatttactcaggggactcccaaacagccagctgccagtgcaggtggagggctgtaggggagggccagtgcccagacagggtcatggggctcagaccagcccactgtagagaatcactctgaggctccaacttccttccttccttcggggccagtctcggccgaagtctggtcacgctcagacagagctgaccagaccagaccgtttgccttttcaagtttcctagtcctgctacaagatgagcttcttccgtggtttccttttggaaactcctccttccaacaagcagtgggatcccggggcccagggcgggccggtgttggccgctggggctgttgtaagtcttgctggatgttcccctgttcctgagccttaacccctcgcacagccatcccccccccccgtcctgccatccccccccgccgtcctgccttccccaccccacccttaggtcccaggtagttgctctgaagagtttcagtagagtggccccagggtgatagctcagggaacaacaaaaaaggaattccgtgaaaacatttttttttctttgatgaattactcctgggtcacttccaccactggtaaagccagaacttctccaaaaagaaccttgcaaaaagtccagtgaatcagtcgaatcattctgtggatgccaaagaatattttgaccataatacagcacagcctggacctgacaacttgtcatttggacttttttttaaatggagttctttagcaacaaagtatagaaacatgttcattgcacacacccaaggagaagagctcaagcgcttggaagaggatgctttgctgctgctgaagtgtacctgggtgttagatttcagatcctgggctgagcccactgtgagctttcctaaactgtgagactcacagaggggaaagatactgacggtgaaaccagcatggaaaacgtctttaccatgtggttccctcctccccaaatacataaagcaaataagcaggatggggaacagcttgaccttcatccacccctaactccaaaactatcaaggtacgacagtggcattgtcatcgacactcaatttcatgtgaattttagcaaaacaggaaacaaagataatgactcagttcagaggatcggacaaatgtgtctagtccgggtggactcggagggagtggggtgggcttcaaggattctgggcgttgggatggcatgagctaccctgtagagtttagtctgcctgcccgccttggtagtagtgaccagtcagtgtcagcatcagtgtcccaaccccagtctctgtttactgcctttgaacagaacttcttccttccccatgctttgggtcacctcgggctgcaaccctgtctgtgccagattgcccggtctgaccctgcaggaagcaaagaggtgagcttaaagaacaaccaaactctgccaggggtcccagaaagcccagggtccagcagtctcagcacttggccccttgccccttcacaccatcctggggcaggggctgggcctccctggtggcaggggtgggtggagaattagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgtgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcaatgttttctgtg

SEQ ID NO: 290473 - DNA, 5161 bp, Homo sapiens
tctgctcgtccataagcgcgtctggtccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagagcggtctgggaggagagcaaagggcaagaagagtgactcgaagaggaagggctgcgagggctccaagggcagcactgagaagaaagagaaagtgaaggcggggcctgactcagtcctggggcagctggcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattctacactgttgtctttcctctgtgctggcctaggacattaggattccttccacggctccggccgctaggaccctgccaggtcccgcgcaccatccctgccctgcccacgtggtattgctgggctcctggctagatgcaagcaaggtggacaagagctcaggactccagcccactgccactgggtgacacagactgtcgtttgggcattatttcatggcagatgggccagtccagggcctaccccgccttgcccccagatcccactggggtccatttggggggtcctgctacactccaccgatccccaaggaagtataataaacgatacccagccagagtctactcactgtcacaagcacaacgagtttatatgagaaagcactgagggggtgcagagggcccgctagttccaggggaactgaaagctgttcctgatcagcccgtatcatctgaggcctgcctgcccaccctgccaccctcccctcccttgctgctctgcccctgccagtgcccagcccagcggctctgggaaggggttcccagaatccctcctgagctgtgccatttactcaggggactcccaaacagccagctgccagtgcaggtggagggctgtaggggagggccagtgcccagacagggtcatggggctcagaccagcccactgtagagaatcactctgaggctccaacttccttccttccttcggggccagtctcggccgaagtctggtcacgctcagacagagctgaccagaccagaccgtttgccttttcaagtttcctagtcctgctacaagatgagcttcttccgtggtttccttttggaaactcctccttccaacaagcagtgggatcccggggcccagggcgggccggtgttggccgctggggctgttgtaagtcttgctggatgttcccctgttcctgagccttaacccctcgcacagccatcccccccccccgtcctgccatccccccccgccgtcctgccttccccaccccacccttaggtcccaggtagttgctctgaagagtttcagtagagtggccccagggtgatagctcagggaacaacaaaaaaggaattccgtgaaaacatttttttttctttgatgaattactcctgggtcacttccaccactggtaaagccagaacttctccaaaaagaaccttgcaaaaagtccagtgaatcagtcgaatcattctgtggatgccaaagaatattttgaccataatacagcacagcctggacctgacaacttgtcatttggacttttttttaaatggagttctttagcaacaaagtatagaaacatgttcattgcacacacccaaggagaagagctcaagcgcttggaagaggatgctttgctgctgctgaagtgtacctgggtgttagatttcagatcctgggctgagcccactgtgagctttcctaaactgtgagactcacagaggggaaagatactgacggtgaaaccagcatggaaaacgtctttaccatgtggttccctcctccccaaatacataaagcaaataagcaggatggggaacagcttgaccttcatccacccctaactccaaaactatcaaggtacgacagtggcattgtcatcgacactcaatttcatgtgaattttagcaaaacaggaaacaaagataatgactcagttcagaggatcggacaaatgtgtctagtccgggtggactcggagggagtggggtgggcttcaaggattctgggcgttgggatggcatgagctaccctgtagagtttagtctgcctgcccgccttggtagtagtgaccagtcagtgtcagcatcagtgtcccaaccccagtctctgtttactgcctttgaacagaacttcttccttccccatgctttgggtcacctcgggctgcaaccctgtctgtgccagattgcccggtctgaccctgcaggaagcaaagaggtgagcttaaagaacaaccaaactctgccaggggtcccagaaagcccagggtccagcagtctcagcacttggccccttgccccttcacaccatcctggggcaggggctgggcctccctggtggcaggggtgggtggagaattagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgtgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcaatgttttctgtg

SEQ ID NO: 290474 - DNA, 6297 bp, Homo sapiens
gaacatacacagggggttggtgaatggtgccgaccgcggccatcgcagttggaggctattttttggggggggtgagtagcgtccatggagttactttgcgcccactcctagcggcaccggcttaggtcctgcgggccgaccgtccccggcggggggcgtggggcctgggacgccgcgggcccggcgcctccctcgccgcgacccggatggatgcgcgccccccgccctcccgcgccggccccaggagctcccggcttcgggagcatccttcccgcgccggtccctgcagcggcgcgtagccgagggcagcgcccgtcaggggggcaccgcggagcaagatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagagcggtctgggaggagagcaaagggcaagaagagtgactcgaagaggaagggctgcgagggctccaagggcagcactgagaagaaagagaaagtgaaggcggggcctgactcagtcctggggcagctggcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattctacactgttgtctttcctctgtgctggcctaggacattaggattccttccacggctccggccgctaggaccctgccaggtcccgcgcaccatccctgccctgcccacgtggtattgctgggctcctggctagatgcaagcaaggtggacaagagctcaggactccagcccactgccactgggtgacacagactgtcgtttgggcattatttcatggcagatgggccagtccagggcctaccccgccttgcccccagatcccactggggtccatttggggggtcctgctacactccaccgatccccaaggaagtataataaacgatacccagccagagtctactcactgtcacaagcacaacgagtttatatgagaaagcactgagggggtgcagagggcccgctagttccaggggaactgaaagctgttcctgatcagcccgtatcatctgaggcctgcctgcccaccctgccaccctcccctcccttgctgctctgcccctgccagtgcccagcccagcggctctgggaaggggttcccagaatccctcctgagctgtgccatttactcaggggactcccaaacagccagctgccagtgcaggtggagggctgtaggggagggccagtgcccagacagggtcatggggctcagaccagcccactgtagagaatcactctgaggctccaacttccttccttccttcggggccagtctcggccgaagtctggtcacgctcagacagagctgaccagaccagaccgtttgccttttcaagtttcctagtcctgctacaagatgagcttcttccgtggtttccttttggaaactcctccttccaacaagcagtgggatcccggggcccagggcgggccggtgttggccgctggggctgttgtaagtcttgctggatgttcccctgttcctgagccttaacccctcgcacagccatcccccccccccgtcctgccatccccccccgccgtcctgccttccccaccccacccttaggtcccaggtagttgctctgaagagtttcagtagagtggccccagggtgatagctcagggaacaacaaaaaaggaattccgtgaaaacatttttttttctttgatgaattactcctgggtcacttccaccactggtaaagccagaacttctccaaaaagaaccttgcaaaaagtccagtgaatcagtcgaatcattctgtggatgccaaagaatattttgaccataatacagcacagcctggacctgacaacttgtcatttggacttttttttaaatggagttctttagcaacaaagtatagaaacatgttcattgcacacacccaaggagaagagctcaagcgcttggaagaggatgctttgctgctgctgaagtgtacctgggtgttagatttcagatcctgggctgagcccactgtgagctttcctaaactgtgagactcacagaggggaaagatactgacggtgaaaccagcatggaaaacgtctttaccatgtggttccctcctccccaaatacataaagcaaataagcaggatggggaacagcttgaccttcatccacccctaactccaaaactatcaaggtacgacagtggcattgtcatcgacactcaatttcatgtgaattttagcaaaacaggaaacaaagataatgactcagttcagaggatcggacaaatgtgtctagtccgggtggactcggagggagtggggtgggcttcaaggattctgggcgttgggatggcatgagctaccctgtagagtttagtctgcctgcccgccttggtagtagtgaccagtcagtgtcagcatcagtgtcccaaccccagtctctgtttactgcctttgaacagaacttcttccttccccatgctttgggtcacctcgggctgcaaccctgtctgtgccagattgcccggtctgaccctgcaggaagcaaagaggtgagcttaaagaacaaccaaactctgccaggggtcccagaaagcccagggtccagcagtctcagcacttggccccttgccccttcacaccatcctggggcaggggctgggcctccctggtggcaggggtgggtggagaattagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgtgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcaatgttttctgtg

SEQ ID NO: 290475 - DNA, 5125 bp, Homo sapiens
gccaccttgaattttctttcccatggcaggctttctggtaaaatccaaaaaacctgctagacaaactaaaagagctataacactccaccttgaaattcttaataatatttgaacaaggagcctatattttcattttacactctagcccacaaattatgaagcccatcttgagggcagcacgtccttctggagagaagcgtataagtagtccctactctttggtggtgttggcaggagggatggacaaaacaagatagctcacctgggtctggcacagggggacagagagaagacgatgcctggtggtgtgctgggagcgtcagtgggcttcctgaaagggtgggacacacgtctgctggcgtctcacttgcctcctctctcccctcagcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattctacactgttgtctttcctctgtgctggcctaggacattaggattccttccacggctccggccgctaggaccctgccaggtcccgcgcaccatccctgccctgcccacgtggtattgctgggctcctggctagatgcaagcaaggtggacaagagctcaggactccagcccactgccactgggtgacacagactgtcgtttgggcattatttcatggcagatgggccagtccagggcctaccccgccttgcccccagatcccactggggtccatttggggggtcctgctacactccaccgatccccaaggaagtataataaacgatacccagccagagtctactcactgtcacaagcacaacgagtttatatgagaaagcactgagggggtgcagagggcccgctagttccaggggaactgaaagctgttcctgatcagcccgtatcatctgaggcctgcctgcccaccctgccaccctcccctcccttgctgctctgcccctgccagtgcccagcccagcggctctgggaaggggttcccagaatccctcctgagctgtgccatttactcaggggactcccaaacagccagctgccagtgcaggtggagggctgtaggggagggccagtgcccagacagggtcatggggctcagaccagcccactgtagagaatcactctgaggctccaacttccttccttccttcggggccagtctcggccgaagtctggtcacgctcagacagagctgaccagaccagaccgtttgccttttcaagtttcctagtcctgctacaagatgagcttcttccgtggtttccttttggaaactcctccttccaacaagcagtgggatcccggggcccagggcgggccggtgttggccgctggggctgttgtaagtcttgctggatgttcccctgttcctgagccttaacccctcgcacagccatcccccccccccgtcctgccatccccccccgccgtcctgccttccccaccccacccttaggtcccaggtagttgctctgaagagtttcagtagagtggccccagggtgatagctcagggaacaacaaaaaaggaattccgtgaaaacatttttttttctttgatgaattactcctgggtcacttccaccactggtaaagccagaacttctccaaaaagaaccttgcaaaaagtccagtgaatcagtcgaatcattctgtggatgccaaagaatattttgaccataatacagcacagcctggacctgacaacttgtcatttggacttttttttaaatggagttctttagcaacaaagtatagaaacatgttcattgcacacacccaaggagaagagctcaagcgcttggaagaggatgctttgctgctgctgaagtgtacctgggtgttagatttcagatcctgggctgagcccactgtgagctttcctaaactgtgagactcacagaggggaaagatactgacggtgaaaccagcatggaaaacgtctttaccatgtggttccctcctccccaaatacataaagcaaataagcaggatggggaacagcttgaccttcatccacccctaactccaaaactatcaaggtacgacagtggcattgtcatcgacactcaatttcatgtgaattttagcaaaacaggaaacaaagataatgactcagttcagaggatcggacaaatgtgtctagtccgggtggactcggagggagtggggtgggcttcaaggattctgggcgttgggatggcatgagctaccctgtagagtttagtctgcctgcccgccttggtagtagtgaccagtcagtgtcagcatcagtgtcccaaccccagtctctgtttactgcctttgaacagaacttcttccttccccatgctttgggtcacctcgggctgcaaccctgtctgtgccagattgcccggtctgaccctgcaggaagcaaagaggtgagcttaaagaacaaccaaactctgccaggggtcccagaaagcccagggtccagcagtctcagcacttggccccttgccccttcacaccatcctggggcaggggctgggcctccctggtggcaggggtgggtggagaattagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgtgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcaatgttttctgtg

SEQ ID NO: 290476 - DNA, 3142 bp, Homo sapiens
gaacatacacagggggttggtgaatggtgccgaccgcggccatcgcagttggaggctattttttggggggggtgagtagcgtccatggagttactttgcgcccactcctagcggcaccggcttaggtcctgcgggccgaccgtccccggcggggggcgtggggcctgggacgccgcgggcccggcgcctccctcgccgcgacccggatggatgcgcgccccccgccctcccgcgccggccccaggagctcccggcttcgggagcatccttcccgcgccggtccctgcagcggcgcgtagccgagggcagcgcccgtcaggggggcaccgcggagcaagatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagagcggtctgggaggagagcaaagggcaagaagagtgactcgaagaggaagggctgcgagggctccaagggcagcactgagaagaaagagaaagtgaaggcggggcctgactcagtcctggggcagctgggtgagtgagggccatgctggcctgcagacacggcaggcttgaccatcaccacgcttgcagctctgtctgccctgcggaaggccagctgcacagagtaggagactgaggctcaagagcggtaaccaggcccttgcttgcccagcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattct

SEQ ID NO: 290477 - DNA, 1683 bp, Homo sapiens
cgctccctaccggctctgatagtgagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgtgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcaatgttttctgtg

SEQ ID NO: 290478 - DNA, 2117 bp, Homo sapiens
gaacatacacagggggttggtgaatggtgccgaccgcggccatcgcagttggaggctattttttggggggggtgagtagcgtccatggagttactttgcgcccactcctagcggcaccggcttaggtcctgcgggccgaccgtccccggcggggggcgtggggcctgggacgccgcgggcccggcgcctccctcgccgcgacccggatggatgcgcgccccccgccctcccgcgccggccccaggagctcccggcttcgggagcatccttcccgcgccggtccctgcagcggcgcgtagccgagggcagcgcccgtcaggggggcaccgcggagcaagatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctttcccctgttggtcacagccgcttctgtctttttccggtctactgtccccagtgtagagggctttgctgtccctgacttagtgacagtgtgtgagcatttgcaatgtaagggcctcagcttccttggagaagccacgtctcgtgtgtccgtatgcaggcatgcctgtgtatactgtgtatgggcacactgtgggactagctgggacaattcctagagattcaactgcccaattctaaccaacattggcagcggctgaacttggcatttccttgctaactgccagatgtggccaacctttgtccatatgcaaaccatttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcaatgttttctgtg

SEQ ID NO: 290479 - DNA, 500 bp, Homo sapiens
tcgaggctcggtaccccgagtttaacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcaatgttttctgtg

SEQ ID NO: 290480 - DNA, 497 bp, Homo sapiens
aagctcggcacccattatttgccggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcaatgttttctgtg

SEQ ID NO: 290481 - DNA, 373 bp, Homo sapiens
tgtcctctgaggttttcctctttttattttgatttttgcctttctctgccagtctttctttctctcataggtccactcccaactatccctcaaactctgtcctttaataggtcagagcagtgtgaattcagttaatcacatttatggaacgtctactatgtgcaaaacatgtgcagagttcagagctatgttatttattgtgctgattgcttttatttcgtcttatttctaagtgcgcaggcagaatgtccacttgagttgcatgtatctgcctcttcctctggcctgtggggcagactgccctgaggcagtctgaagtcactctttcccctcttgcccctcacaggttttccggacagacttgatcacagcc

SEQ ID NO: 290482 - DNA, 812 bp, Homo sapiens
tcacattaacgcacacatcagttccaggccccattccattctctgaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactca

SEQ ID NO: 290483 - DNA, 336 bp, Homo sapiens
tatgtcgaacccacgcgttccggattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactca

SEQ ID NO: 290484 - DNA, 303 bp, Homo sapiens
tcactcggcccggtatgctgatctcaacgtagtcatcatcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactca

SEQ ID NO: 290485 - DNA, 302 bp, Homo sapiens
tctagaggatccctcacagcttcgggctaacccaaagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactca

SEQ ID NO: 290486 - DNA, 2569 bp, Homo sapiens
tcacattaacgcacacatcagttccaggccccattccattctctgaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaatctttg

SEQ ID NO: 290487 - DNA, 2516 bp, Homo sapiens
tcacattaacgcacacatcagttccaggccccattccattctctgaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccgcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaatctttg

SEQ ID NO: 290488 - DNA, 2514 bp, Homo sapiens
tcacattaacgcacacatcagttccaggccccattccattctctgaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaatatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaatctttg

SEQ ID NO: 290489 - DNA, 2515 bp, Homo sapiens
tcacattaacgcacacatcagttccaggccccattccattctctgaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaattttcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaatctttg

SEQ ID NO: 290490 - DNA, 2409 bp, Homo sapiens
tcacattaacgcacacatcagttccaggccccattccattctctgaacatcttctgacacactgacagtgctgagcagagcaagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaatctttg

SEQ ID NO: 290491 - DNA, 1557 bp, Homo sapiens
tcacattaacgcacacatcagttccaggccccattccattctctgaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaaagtcgacgcggccgcgaatttagtagtagtaggcggccga

SEQ ID NO: 290492 - DNA, 2203 bp, Homo sapiens
gcggccgcctactactactactgctcgaattcaagcttctaacgatgtacggggacatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaatctttg

SEQ ID NO: 290493 - DNA, 2516 bp, Homo sapiens
tcacattaacgcacacatcagttccaggccccattccattctctgaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcattgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaatctttg

SEQ ID NO: 290494 - DNA, 2093 bp, Homo sapiens
tatgtcgaacccacgcgttccggattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaatctttg

SEQ ID NO: 290495 - DNA, 1925 bp, Homo sapiens
tagaggatcccccacacttcgatcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaatctttg

SEQ ID NO: 290496 - DNA, 1472 bp, Homo sapiens
cagaactctgtttggccttatttttcatgagcgcattcaagtgggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaatctttg

SEQ ID NO: 290497 - DNA, 927 bp, Homo sapiens
tcacattaacgcacacatcagttccaggccccattccattctctgaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttccgtcctcatcgtagtctatctggaagtggcgggactccctgattgactggtcatctttgaaccggacaacctcggggtctgggtatccttcaatcttgcagtcaaatctagcagcagttccctccacaacttctaaatcgcgagtcgacgc

SEQ ID NO: 290498 - DNA, 799 bp, Homo sapiens
  misc_feature (719)..(719): n is a, c, g, or t
  misc_feature (721)..(721): n is a, c, g, or t
  misc_feature (733)..(733): n is a, c, g, or t
  misc_feature (736)..(736): n is a, c, g, or t
  misc_feature (766)..(767): n is a, c, g, or t
  misc_feature (770)..(770): n is a, c, g, or t
  misc_feature (772)..(773): n is a, c, g, or t
tcacattaacgcacacatcagttccaggccccattccattctctgaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggtgttcnanagaatcagcaanagnattttccagccttggaaaacaagagcaagnnggnannggaggctctcaataaataatggtgtt

SEQ ID NO: 290499 - DNA, 635 bp, Homo sapiens
gttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaaggtaggaggagtttctccagccagctggtgagaaagaaagggctggggaacaaaggggcattttgaggtttggttggttttgtcttttttttttttttttaatattccctgcaaggataaattcagaagtaatttgggttgccctgacaattactaagtctaataattattcttaatcgtttaactttaagcttaaccattttcggagggaaagttgttatttgtctaatagaactagatgacctcagctatgctttttcatatatttgtgttaaaattaacaaagattgtattaaaatcttctttgttcttatggcaaaagtgatattctatattaataggcaaa

SEQ ID NO: 290500 - DNA, 2590 bp, Homo sapiens
tgcctcggcctcccaaagtactgggattataggcatgagccaccatgcccggcctttgctcttaactactgatgttgtcttcctgatcttttctacaagaagcttttaaactttttggactttaacctacaataagaaatccattttacatgttcacatgtatctataacaacatttatatttctaaaacaaacttttcatgaaacaagatatacctacatatgtcaggcactctgatattttctattctagtccaccttttccatttcattctatttatgggaaatatatgttggttgggagtcactgagttaatttaatgacccactaataggctgtgagtggcattggaaaaatacctgcttgtaagatatgcgaacacacgtttcaaggttgtttgtgcatgtggaaatattttggggtgctatctgttttaccatcagtttgtacaaggacactaagacagtgtagcctgctgacttgagaatgttctgtaaggactggaaacactagaatcttgaagaaacgcctggctagaggtgagggtaagctgttaattacactgattacagtttgtgcctctcagactgagaactcttttcttcttgctgggggcattgctatctctaggatgtttgccctgaagtcctgatagtctctttggggttttaataaatggctgaaaaaattgttgtggggtttcaacaggcgttcataggcacccttgcttggcaatataacatggcttttgatgtttgggtgttggaagggatctttgaagtgctgagagggactcagtctttttccaaaatctctgcttgtgtctgtccagcctctggctccactgcttggctgagatcctggcccatagtagaatctgtgtagaggaaacgagagctcactatttgtgaggcagcctgttccactattggactgctttaaatgtagtgatcagtgattatgctataatccaatcatgtattaattgggcaccaactatgcactaggcatggtatcaagtaccaggagtacaaaaataagtaaaccttgatttctgctatcaattactctcttctcctacttctgtactactgcttttctattgtgagtttgtttagttcattaattggtttattcattcattcaacaatcatatactgattagctactctgaccaggtccagtactaactctgaagaagttatgcccatcccatcttcaccccaagccttctccttttgagactcctcatccagtttctttagttcttcatatatcactgtttttcagatctctggctatccttgccattgacctcagaaatcctgtatttgaccttaaccttcttatacccagtccatacccaaagtgatggaaatggaatagatttctttttaaagttttaaacgaatattttgactgaaaaattttggcagtcttgtatgcaaatgacactgcagagcattgttttctcccccccacgtaggagattttattcaactaaggcacaggcatattaaaagactttcagtataaggaaaaggggtagtttattccctccaaatttgactacagctcgaaattgtctttattaatgcaaagttcttttgtcaccttgactttgggacactgttaccaaacctcgtgggaaatatcaagttccagaagattgaatacatgcaggaaacaaatgttttttgggccctagagtgaacatttggtccatatgaaaatgaccaggaagacaattaggtgaaggttttttaatgatttgtgctacgtcagtctcttcccataagacatattcaaagttttaacttttccttaagaggcttccatggggagcaagcatttgataattcatcctttaagaaaaacaccaccgtacactgcttgaagagttcctcttctattacttaaaacgtttttattgtgcaacatttaaggcatacaaaaacatataaagaataccatgatgaaaatctatgactgtattaccaagcttaagaaataaaacagttgagtgatctctcatttatgactaaattaacttattaaaaccattaaaacttttggattattcctgttaagatattttcttttttttattattatgctttaagttctagggtacatgtgcacaatgtgcaggtttgttacatatgtatacatgcaccatgttggtgtgctgcacccattaactcgtcatttacattaggtatatatcctaatgctatccctcccccctccacccaccccatgacaggtcccggtgtgtgatgttccccactctgtgtccaagtgttctcattgttcaattcccacctatgagtgagaacatgcggtgtttggttttttgtccttgcaatagtttgctgagaaagatggtgtccagcttcatccatgtccctgcaaaggacatgaactcatccttttttatggctgcatagtattccatggtgtatatgtgccacattttcttaatccagtctatcattattggacatttgggttggttccaagtctttgctattgtgaatagtgcctcaataaacatatatgtgcatgtgtctttatagcagcatgattt

SEQ ID NO: 290501 - DNA, 201 bp, Homo sapiens
cgtctctgggtggaggggagggcggcggatgggcctgggctggagcccggagcggcccaggtgcagggtcggcgcggcggcggcagcggcggcggcggcggcggcggcggcggcaggggcggcggcggtgctgacggcggctgcggaggcgggcgacacttgcacgtgtaagtgtgctcacgatctgtgcgtgcacagctg

SEQ ID NO: 290502 - DNA, 511 bp, Homo sapiens
ttcgacctttgggaattacagctgaacgtgagatttgtgttcggacagaggaaagccatatcatttggcttgtttacacctttggctagtgtgaataatgctgctatgaacaaagacatgcagatacctgctggggcccctgctctcagttcttttcagaatacaccagaagtagaattgctgcatcgtgtgatccctgggtgtcctgctgccccctcacatggagaaatcccagcactgggagaaaggacagggtctgtattatcagatacatgcagccactcctccagcgtcccctctcccatagggcaagtccggatgctccaggctctccccagtgttgctgttagatttctctgcagagctgggatctccattccccatactttgctgctttttgtttgtttgtttcctgtttctcaaggcatataaagctgcaggaatacagatgggattggatctgcggcacctaaaacaaatgctggataaacatttccagaatgtatgaagc

SEQ ID NO: 290503 - DNA, 1068 bp, Homo sapiens
tctgtctgcagattccagcagtggctcttctcctcaccctttttgggctatggtggtaagagatacccaatgataacagctctgggaaaatgctaacccatttttttctggagttctctcaagccctcatgtcaattatcccacgatacgcagatgctacatagcaacgtttgggtcagcgacgaattgcgtatagaacggtggtctgctgagatgacaatagtgtatttatgctgtaccttttctatgtttagatgtgtgtagatgcacaaatacttgccgtggtgttaagattgcctgcagtattcacaccataacatgcactgcaggcttgtagcctaggagcagtcgactctagcgtccatcctgggtgtgtattgggctgtaccatctgggttggtgtaagtgcacgctacaatgttcctatggtcataaaatcacctaacgacacatttctaacgacacgtccctgtcgttaagcaatgcatgactgtactaacctctcctgcagttgctcagatggggcgagcctcctgtttgtgctagggccctggctgctaggctggaagcctcatacgtctcagtgcatcttcccctcccaggtcatggtgatgcccaaatacgtttggctggagcaccctgaagtctctgctaccatccaagctggtttggagacgtgaaccagaccaatgaagggcaggctttagatggtcattttctcattaggctcctctcctcccccacgctagatccctgggtgtcctgctgccccctcacatggagaaatcccagcactgggagaaaggacagggtctgtattatcagatacatgcagccactcctccagcgtcccctctcccatagggcaagtccggatgctccaggctctccccagtgttgctgttagatttctctgcagagctgggatctccattccccatactttgctgctttttgtttgtttgtttcctgtttctcaaggcatataaagctgcaggaatacagatgggattggatctgcggcacctaaaacaaatgctggataaacatttccagaatgtatgaagc

SEQ ID NO: 290504 - DNA, 2864 bp, Homo sapiens
  misc_feature (533)..(533): n is a, c, g, or t
  misc_feature (576)..(576): n is a, c, g, or t
  misc_feature (2835)..(2835): n is a, c, g, or t
gtccacaggcaaagtgagttgaggcaggaagattgtgagatggcctcacccaggctcccaggtccttaatcaaccacctgagctagtttcccaaaagcagcccacagagggtgctccagcaaatggcccctcctcagtgctcagaccccatgtggtctcccacggccctggcctccaggatggctgccaaacaaagggaggaggagtaaggctgaagtcctcagccttctggggtgggtcctccagtctggaggcagaattccaccccctggtctgacctctcccaaggtggggagaggtggtcccaggccaagggaaggaatttttcctgaggcccagcagcctcctgaagacaccatcatggtagcagagggggcttaggtgcggggagaaggggggtctgaaaagaggcagcccatccaggctcagagatggaaccccctgctccgctgggccacggtgcctctcagcctcaggatcctatcaccgttgttggggtgagagggctggtgtgctcttttcaccaagcgggntttctggcctggcctcgggggtgtgggacacagcatcgcttcntctccactagcctgagggccaccattgtcccatctgtgtccccagccccacttcaaagcctcacacatacactgtgcacagcaattatctatgaaggagtaaaggaatttttgccattggggttgtgctggggggtgacttcagagcatcagagctgactccttactcgggaagcaatgggcccatgtagatggggaagggacgtcatcttgggagacgggatgtccgacttggtgctggtggctcaccagcttcttgggacaaacagcagctcctgcgcccctggtagagccagcaggcttgggtggttaggtttggtctcctctgagaggctctgggtggccccacaacatctgggctattttgttactggtacaagcttccggtctcccacaggccaagggaagttcttaaagcaatgaaaaaaaaaaaaaaaaaggaacagagacagagtcttgccaggttgcccaggttggaatgcagtgatatgatcatagcccaccgcatgacttctgggctcaagcagccctcctgcctctgcctcctgagtggctgagactacaggcatgcatcagctcttcttaaagcaattcatcttcccccatgtctagcctcatctgtgtccccagccccactggggcagaaagctgtggaatgttactcacactgtcattggatcaacccctggctttcctgtggggatcccctccctgggaggggttcccatgacaatttgggctccagaaagggatgtgggaggagagtgcggtggagggaggtggtctgtggtctcccttcatggaccagaaagcttgacccccaaggggaccctggcttctacttcctcagagctaagcagtgccaaggggcagcctgagacatgggcaaaggggaagcctaaatggaaaaagagagagagagagagagaaagagagaaggggcagggaggacaaagacacatggcaagtgtccaagctggaacattcccaccagtggccttattgcattaaggattttcccaaaaagcagaaatacactgatagtcaatggaacatagcagagctgtcacgagcccaggaaacacaagtcccacctctacacagccagagactgtgtgactgtcccaaattttaaatcaagatagacaataagaacctaccactttcacatccaagaaaactgtgtccctacacatttcagtcacaccgtgctgtggcttgaggccagccagatgcaaaaatcaggaaggttctgaggggtagggccttctgtctttctgaaaggggcccctgagcggagggggcagtgctgggggagctaaagcgcagtgggctgtcacttcacgactatgacttctgtttcccaagtgcacttcctgaccctgagatttgtgccatggcacacaggaatcagggcacttccgtttacatatacgctcattatcaggactggcgtcgtgggtgtggggcctgggcagtcacagggccctgttcttagaaggtgccccggcttgctttaatgctgtgttgttgtccttttgaaagccttactattttaacaaggggccctgcatttttatattgcacagggccctgcaattatgcagccattcctgcttttgatctcacttaccccacagccataatggaagagcgcctggaaggagtccttatcctgattcccagatggtgaaactgagtgccaggaggggcagtgctgaagccgagaccagacaggatccctcgggtggaatccagggctgctgtttctcttgggggctcctcctcagtgaatggatgggtggtaatctcctttcctacctgtcctagcggtagcctctgttccttctcttgttttatctcattttatttttttaaaaaataccaaaaccattctctcacctgccagagaggagctcataggagttgggcttcctcagagagtgttcctccctcgtcccctgtcctgtccaggcacctgcgagcaggatggtgtgtccccggctaaatccacaggcgctccactctgtcccagagagcccacagccaaaaacttcgtcctgtcctggaaaagcttcactgccttccaacagagccttcctgcatgccgaggttgaagaggtgtccgctgagtgctctgtcttctgggaattttggctgtttcctgcaacctatcatcagatgccacacttatgagaccctcatccttctgctcactctcttccattgtttcactcattaaaaatatatattttaagcntaaaaaaaaaatcggcctcttgggcctca

SEQ ID NO: 290505 - DNA, 2694 bp, Homo sapiens
  misc_feature (533)..(533): n is a, c, g, or t
  misc_feature (576)..(576): n is a, c, g, or t
  misc_feature (2665)..(2665): n is a, c, g, or t
gtccacaggcaaagtgagttgaggcaggaagattgtgagatggcctcacccaggctcccaggtccttaatcaaccacctgagctagtttcccaaaagcagcccacagagggtgctccagcaaatggcccctcctcagtgctcagaccccatgtggtctcccacggccctggcctccaggatggctgccaaacaaagggaggaggagtaaggctgaagtcctcagccttctggggtgggtcctccagtctggaggcagaattccaccccctggtctgacctctcccaaggtggggagaggtggtcccaggccaagggaaggaatttttcctgaggcccagcagcctcctgaagacaccatcatggtagcagagggggcttaggtgcggggagaaggggggtctgaaaagaggcagcccatccaggctcagagatggaaccccctgctccgctgggccacggtgcctctcagcctcaggatcctatcaccgttgttggggtgagagggctggtgtgctcttttcaccaagcgggntttctggcctggcctcgggggtgtgggacacagcatcgcttcntctccactagcctgagggccaccattgtcccatctgtgtccccagccccacttcaaagcctcacacatacactgtgcacagcaattatctatgaaggagtaaaggaatttttgccattggggttgtgctggggggtgacttcagagcatcagagctgactccttactcgggaagcaatgggcccatgtagatggggaagggacgtcatcttgggagacgggatgtccgacttggtgctggtggctcaccagcttcttgggacaaacagcagctcctgcgcccctggtagagccagcaggcttgggtggttaggtttggtctcctctgagaggctctgggtggccccacaacatctgggctattttgttactggtacaagcttccggtctcccacaggccaagggaagttcttaaagcaatgaaaaaaaaaaaaaaaaaggaacagagacagagtcttgccaggttgcccaggttggaatgcagtgatatgatcatagcccaccgcatgacttctgggctcaagcagccctcctgcctctgcctcctgagtggctgagactacaggcatgcatcagctcttcttaaagcaattcatcttcccccatgtctagcctcatctgtgtccccagccccactggggcagaaagctgtggaatgttactcacactgtcattggatcaacccctggctttcctgtggggatcccctccctgggaggggttcccatgacaatttgggctccagaaagggatgtgggaggagagtgcggtggagggaggtggtctgtggtctcccttcatggaccagaaagcttgacccccaaggggaccctggcttctacttcctcagagctaagcagtgccaaggggcagcctgagacatgggcaaaggggaagcctaaatggaaaaagagagagagagagagagaaagagagaaggggcagggaggacaaagacacatggcaagtgtccaagctggaacattcccaccagtggccttattgcattaaggattttcccaaaaagcagaaatacactgatagtcaatggaacatagcagagctgtcacgagcccaggaaacacaagtcccacctctacacagccagagactgtgtgactgtcccaaattttaaatcaagatagacaataagaacctaccactttcacatccaagaaaactgtgtccctacacatttcagtcacaccgtgctgtggcttgaggccagccagatgcaaaaatcaggaaggttctgaggggtagggccttctgtctttctgaaaggggcccctgagcggagggggcagtgctgggggagctaaagcgcagtgggctgtcacttcacgactatgacttctgtttcccaagtgcacttcctgaccctgagatttgtgccatggcacacaggaatcagggcacttccgtttacatatacgctcattatcaggactggcgtcgtgggtgtggggcctgggcagtcacagggccctgttcttagaaggtgccccggcttgctttaatgctgtgttgttgtccttttgaaagccttactattttaacaaggggccctgcatttttatattgcacagggccctgcaattatgcagccattcctgcttttgatctcacttaccccacagccataatggaagagcgcctggaaggagtccttatcctgattcccagatggtgaaactgagtgccaggaggggcagtgctgaagccgagaccagacaggatccctcgggtggaatccagggctgctgtttctcttgggggctcctcctcagtgaatggatgggtggcacctgcgagcaggatggtgtgtccccggctaaatccacaggcgctccactctgtcccagagagcccacagccaaaaacttcgtcctgtcctggaaaagcttcactgccttccaacagagccttcctgcatgccgaggttgaagaggtgtccgctgagtgctctgtcttctgggaattttggctgtttcctgcaacctatcatcagatgccacacttatgagaccctcatccttctgctcactctcttccattgtttcactcattaaaaatatatattttaagcntaaaaaaaaaatcggcctcttgggcctca

SEQ ID NO: 290506 - DNA, 1391 bp, Homo sapiens
  misc_feature (536)..(536): n is a, c, g, or t
  misc_feature (620)..(620): n is a, c, g, or t
ccatggcctttgtggggagagaaacactaaacagccagttctttaattactactgtggtaagtggaaatgcagaataggttcttgggccgagggctaggggttttgttacaatgtgattttcttatttatatatttaatttacctggtctttacgtctttagcgaaaaaaacaagaacaacttactcctggagtagtctatgtgcgccacctacctaacctacttgacgaaacccagatcttttcatatttctcccagtttggcactgtgacacggttcaggctgtccagaagtaaaagggtaagatttttgcagttggatttaatgttttgtttttcaaatgtgtattatccttgacattaaagagcacgttcacgcatacattattgcttatcagatttcattccaaaaaggagagtggaggaggtttagaatctgaaacagctacaggagcaaaatcagtattattgtaaaagtttgttttttacatttctccaaatccttacattaaattgacagtcctggtaaatgagctntagtatgaggcccaggtttatacattttcttgtgttagcctttggtacaagcatccttataatagcaaaggtttatatagtgantagttaaaggtgaggactctggagttggactgctgaggtttggggtcaggctctacaccttactagttagagtgatatgaccttaccatgtttcagtgttgtgatctgttaaatataagtaaaacttcctgggagtatttagtcaaaggttaaatataaagtctttagaggattgcttggtacacaataaacactatataagtataattactatttgtgtcatacctgccttctaatgagaaaacgctttacatagcttgtttcaatagtggaggagtgacccactttcttttctttccccgcacataaactttaattggttgtagccatagacacctatttgatttagcatgtgggggatagggtgcacatccatcatctgttagttgtcgtaaagatagattgtaggtagaattgaggtcccttttgtacccttcccagtgctcttcaacttctttaattagggaattaaattcacaaattcagttttcttttttttgagactgaggcttgcactccagcctgggggacagagcaagactctgtctcaaacaaaaaaaaaaaaaaggaaaagataagaaaaacaagtgtttatatgaagtattttctcagaaaaagagtaacccaaatacttttcaagtccatgtggcttgattaatctttaataaataagaatattggtgatttagtaaaaatggatattctacctagctttgttaatcaaataaactcatattatctctgttacaaaatttgccagcaagaaaattt

SEQ ID NO: 290507 - DNA, 678 bp, Homo sapiens
ctgcttttcctgtaccctgtttgtgacttaggagatgggggtggcctgcctttgcacattcttcctgcttccaccctcctgaattcaggattctgtgaatcagtgagctccaggttttggccttcccttcaacctctgcagctctgtcaattcctctactgggtttttcctagttttgccctttacttgagataattcactgtatttatgagttttgattttttaaaatgaaatgctcttgtcatttagggaggatttactgataatatatatgaggatctaatgctaagtttagaaagaaaagatatgagtgtcaatttctaacttctttattaaagattttacagaaaacggaaagtatttcaaaaactaatcgtcagacgtctacaaaaggccaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggtagaattgaccccagtagtagcactagaccccaatagagcacaagacccccg

SEQ ID NO: 290508 - DNA, 1639 bp, Homo sapiens
gggggagctgggagcccgacgtttccgggagcgccgcgtggttagcgtcggcggcttttggcatggcgactttttctggcccggctgggccaatcctgtcgcttaatccgcaggaagatgtcgagtttcaaaaggaggtggcgcaggttcgcaagcgcataacccagcgaaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaaggaaagcagtgtgtaattttggattgcctgcccttggctgaaatacaggggtgcataccatcttgcagtggcttggctgacattgcctctttgtcctggcctctagttttcttttgatatttcatagctctccttagtttactctgcctggatagaaagttgaccactaactgcaggtttaagtactaaactgcagccttttctgtcgccagcaattaaagaccaccaatcttgtttgtccatctacatggtttgtcggggacatttaactcatggaggtgctttagatttcaacatcagatggttgaagctggaagtttaattatatgtagagtgagaaggcagttccagttttagcacagatttgtttatgtgttcagattttaatagagattcaaaaatgactcatttttaccaataatgttaaattagttttggttgtgctagcatgaattaataaccaccattttataccagtatcatcagtgaagaattgtatttcaagattcaaacaataaccagcaattaaacttttttctacaatgtatttgtttgcgagtag

SEQ ID NO: 290509 - DNA, 1734 bp, Homo sapiens
gggggagctgggagcccgacgtttccgggagcgccgcgtggttagcgtcggcggcttttggcatggcgactttttctggcccggctgggccaatcctgtcgcttaatccgcaggaagatgtcgagtttcaaaaggaggtggcgcaggttcgcaagcgcataacccagcgaaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaaggaaagcagtgtgtaattttggattgcctgcccttggctgaaatacaggggtgcataccatcttgcagtggcttggctgacattgcctctttgtcctggcctctagttttcttttgatatttcatagctctccttagtttactctgcctggatagaaagttgaccactaactgcaggtttaagtactaaactgcagccttttctgtcgccagcaattaaagaccaccaatcttgtttgtccatctacatggtttgtcggggacatttaactcatggaggtgctttagatttcaacatcagatggttgaagctggaagtttaattatatgtagagtgagaaggcagttccagttttagcacagatttgtttatgtgttcagattttaatagagattcaaaaatgactcatttttaccaataatgttaaattagttttggttgtgctagcatgaattaataaccaccattttataccagtatcatcagtgaagaattgtatttcaagattcaaacaataaccagcaattaaacttttttctacaatgtatttgtttgcgagtaggacttgggagtcattgggaaaaaaaaataataaattttccccttcattaacgaattcagactcattaaaaacattgccatcagaaaaaaaaaaaa

SEQ ID NO: 290510 - DNA, 991 bp, Homo sapiens
gggggagctgggagcccgacgtttccgggagcgccgcgtggttagcgtcggcggcttttggcatggcgactttttctggcccggctgggccaatcctgtcgcttaatccgcaggaagatgtcgagtttcaaaaggaggtggcgcaggttcgcaagcgcataacccagcgaaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgag

SEQ ID NO: 290511 - DNA, 2014 bp, Homo sapiens
gggggagctgggagcccgacgtttccgggagcgccgcgtggttagcgtcggcggcttttggcatggcgactttttctggcccggctgggccaatcctgtcgcttaatccgcaggaagatgtcgagtttcaaaaggaggtggcgcaggttcgcaagcgcataacccagcgaaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggttttacgtaagaagaagaaaaaagtttcaggtactcttgacactcctgagaagactgtggatagccaggtaaaatggttttcaatactccagacaccagatattatagaaataatttgaaggaggagaagcagtttctgctactctcattttaagatttcaaattaaatattgtgacatttggtagatctttattgttgatttagcaattttctgcctaaaaccttataatggaacatgctatatttgttaattgtgaatttctgtaccaagtttgataagcatctaagttctttattctttgcaatagtatcaccaaaagatggtaacagagctaaaataatggggcacaacttgtaaaaatagaggagagatgatatttttgggtaaagtcataatcatgttttacatttatgtattataatctttacttgttgaatccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaaggaaagcagtgtgtaattttggattgcctgcccttggctgaaatacaggggtgcataccatcttgcagtggcttggctgacattgcctctttgtcctggcctctagttttcttttgatatttcatagctctccttagtttactctgcctggatagaaagttgaccactaactgcaggtttaagtactaaactgcagccttttctgtcgccagcaattaaagaccaccaatcttgtttgtccatctacatggtttgtcggggacatttaactcatggaggtgctttagatttcaacatcagatggttgaagctggaagtttaattatatgtagagtgagaaggcagttccagttttagcacagatttgtttatgtgttcagattttaatagagattcaaaaatgactcatttttaccaataatgttaaattagttttggttgtgctagcatgaattaataaccaccattttataccagtatcatcagtgaagaattgtatttcaagattcaaacaataaccagcaattaaacttttttctacaatgtatttgtttgcgagtag

SEQ ID NO: 290512 - DNA, 1634 bp, Homo sapiens
ccatggcctttgtggggagagaaacactaaacagccagttctttaattactactgtggtaagtggaaatgcagaataggttcttgggccgagggctaggggttttgttacaatgtgattttcttatttatatatttaatttacctggtctttacgtctttagcgaaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaaggaaagcagtgtgtaattttggattgcctgcccttggctgaaatacaggggtgcataccatcttgcagtggcttggctgacattgcctctttgtcctggcctctagttttcttttgatatttcatagctctccttagtttactctgcctggatagaaagttgaccactaactgcaggtttaagtactaaactgcagccttttctgtcgccagcaattaaagaccaccaatcttgtttgtccatctacatggtttgtcggggacatttaactcatggaggtgctttagatttcaacatcagatggttgaagctggaagtttaattatatgtagagtgagaaggcagttccagttttagcacagatttgtttatgtgttcagattttaatagagattcaaaaatgactcatttttaccaataatgttaaattagttttggttgtgctagcatgaattaataaccaccattttataccagtatcatcagtgaagaattgtatttcaagattcaaacaataaccagcaattaaacttttttctacaatgtatttgtttgcgagtag

SEQ ID NO: 290513 - DNA, 1759 bp, Homo sapiens
gggggagctgggagcccgacgtttccgggagcgccgcgtggttagcgtcggcggcttttggcatggcgactttttctggcccggctgggccaatcctgtcgcttaatccgcaggaagatgtcgagtttcaaaaggaggtggcgcaggttcgcaagcgcataacccagcgaaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggtaaaattttttttatcattttacatgcaagatattagagaaggataagtaggaaaacatattcaagactactgtagctgatcaatattcaaattgatgtgttttaaaatttattttaaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaaggaaagcagtgtgtaattttggattgcctgcccttggctgaaatacaggggtgcataccatcttgcagtggcttggctgacattgcctctttgtcctggcctctagttttcttttgatatttcatagctctccttagtttactctgcctggatagaaagttgaccactaactgcaggtttaagtactaaactgcagccttttctgtcgccagcaattaaagaccaccaatcttgtttgtccatctacatggtttgtcggggacatttaactcatggaggtgctttagatttcaacatcagatggttgaagctggaagtttaattatatgtagagtgagaaggcagttccagttttagcacagatttgtttatgtgttcagattttaatagagattcaaaaatgactcatttttaccaataatgttaaattagttttggttgtgctagcatgaattaataaccaccattttataccagtatcatcagtgaagaattgtatttcaagattcaaacaataaccagcaattaaacttttttctacaatgtatttgtttgcgagtag

SEQ ID NO: 290514 - DNA, 1662 bp, Homo sapiens
gggggagctgggagcccgacgtttccgggagcgccgcgtggttagcgtcggcggcttttggcatggcgactttttctggcccggctgggccaatcctgtcgcttaatccgcaggaagatgtcgagtttcaaaaggaggtggcgcaggttcgcaagcgcataacccagcgaaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtaaaacctggccttttgtagacgtctgacgattacaaaaggccaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaaggaaagcagtgtgtaattttggattgcctgcccttggctgaaatacaggggtgcataccatcttgcagtggcttggctgacattgcctctttgtcctggcctctagttttcttttgatatttcatagctctccttagtttactctgcctggatagaaagttgaccactaactgcaggtttaagtactaaactgcagccttttctgtcgccagcaattaaagaccaccaatcttgtttgtccatctacatggtttgtcggggacatttaactcatggaggtgctttagatttcaacatcagatggttgaagctggaagtttaattatatgtagagtgagaaggcagttccagttttagcacagatttgtttatgtgttcagattttaatagagattcaaaaatgactcatttttaccaataatgttaaattagttttggttgtgctagcatgaattaataaccaccattttataccagtatcatcagtgaagaattgtatttcaagattcaaacaataaccagcaattaaacttttttctacaatgtatttgtttgcgagtag

SEQ ID NO: 290515 - DNA, 1179 bp, Homo sapiens
  misc_feature (13)..(13): n is a, c, g, or t
cccttatggctgntgcacattgccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaaggaaagcagtgtgtaattttggattgcctgcccttggctgaaatacaggggtgcataccatcttgcagtggcttggctgacattgcctctttgtcctggcctctagttttcttttgatatttcatagctctccttagtttactctgcctggatagaaagttgaccactaactgcaggtttaagtactaaactgcagccttttctgtcgccagcaattaaagaccaccaatcttgtttgtccatctacatggtttgtcggggacatttaactcatggaggtgctttagatttcaacatcagatggttgaagctggaagtttaattatatgtagagtgagaaggcagttccagttttagcacagatttgtttatgtgttcagattttaatagagattcaaaaatgactcatttttaccaataatgttaaattagttttggttgtgctagcatgaattaataaccaccattttataccagtatcatcagtgaagaattgtatttcaagattcaaacaataaccagcaattaaacttttttctacaatgtatttgtttgcgagtag

SEQ ID NO: 290516 - DNA, 1351 bp, Homo sapiens
ctgcttttcctgtaccctgtttgtgacttaggagatgggggtggcctgcctttgcacattcttcctgcttccaccctcctgaattcaggattctgtgaatcagtgagctccaggttttggccttcccttcaacctctgcagctctgtcaattcctctactgggtttttcctagttttgccctttacttgagataattcactgtatttatgagttttgattttttaaaatgaaatgctcttgtcatttagggaggatttactgataatatatatgaggatctaatgctaagtttagaaagaaaagatatgagtgtcaatttctaacttctttattaaagattttacagaaaacggaaagtatttcaaaaactaatcgtcagacgtctacaaaaggccaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaaggaaagcagtgtgtaattttggattgcctgcccttggctgaaatacaggggtgcataccatcttgcagtggcttggctgacattgcctctttgtcctggcctctagttttcttttgatatttcatagctctccttagtttactctgcctggatagaaagttgaccactaactgcaggtttaagtactaaactgcagccttttctgtcgccagcaattaaagaccaccaatcttgtttgtccatctacatggtttgtcggggacatttaactcatggaggtgctttagatttcaacatcagatggttgaagctggaagtttaattatatgtagagtgagaaggcagttccagttttagcacagatttgtttatgtgttcagattttaatagagattcaaaaatgactcatttttaccaataatgttaaattagttttggttgtgctagcatgaattaataaccaccattttataccagtatcatcagtgaagaattgtatttcaagattcaaacaataaccagcaattaaacttttttctacaatgtatttgtttgcgagtag

SEQ ID NO: 290517 - DNA, 1846 bp, Homo sapiens
ctgcttttcctgtaccctgtttgtgacttaggagatgggggtggcctgcctttgcacattcttcctgcttccaccctcctgaattcaggattctgtgaatcagtgagctccaggttttggccttcccttcaacctctgcagctctgtcaattcctctactgggtttttcctagttttgccctttacttgagataattcactgtatttatgagttttgattttttaaaatgaaatgctcttgtcatttagggaggatttactgataatatatatgaggatctaatgctaagtttagaaagaaaagatatgagtgtcaatttctaacttctttattaaagattttacagaaaacggaaagtatttcaaaaactaatcgtcagacgtctacaaaaggccaggtaaaattttttttatcattttacatgcaagatattagagaaggataagtaggaaaacatattcaagactactgtagctgatcaatattcaaattgatgtgttttaaaatttattttaaggttttacgtaagaagaagaaaaaagtttcaggtactcttgacactcctgagaagactgtggatagccaggtaaaatggttttcaatactccagacaccagatattatagaaataatttgaaggaggagaagcagtttctgctactctcattttaagatttcaaattaaatattgtgacatttggtagatctttattgttgatttagcaattttctgcctaaaaccttataatggaacatgctatatttgttaattgtgaatttctgtaccaagtttgataagcatctaagttctttattctttgcaatagtatcaccaaaagatggtaacagagctaaaataatggggcacaacttgtaaaaatagaggagagatgatatttttgggtaaagtcataatcatgttttacatttatgtattataatctttacttgttgaatccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaaggaaagcagtgtgtaattttggattgcctgcccttggctgaaatacaggggtgcataccatcttgcagtggcttggctgacattgcctctttgtcctggcctctagttttcttttgatatttcatagctctccttagtttactctgcctggatagaaagttgaccactaactgcaggtttaagtactaaactgcagccttttctgtcgccagcaattaaagaccaccaatcttgtttgtccatctacatggtttgtcggggacatttaactcatggaggtgctttagatttcaacatcagatggttgaagctggaagtttaattatatgtagagtgagaaggcagttccagttttagcacagatttgtttatgtgttcagattttaatagagattcaaaaatgactcatttttaccaataatgttaaattagttttggttgtgctagcatgaattaataaccaccattttataccagtatcatcagtgaagaattgtatttcaagattcaaacaataaccagcaattaaacttttttctacaatgtatttgtttgcgagtag

SEQ ID NO: 290518 - DNA, 1680 bp, Homo sapiens
gggggagctgggagcccgacgtttccgggagcgccgcgtggttagcgtcggcggcttttggcatggcgactttttctggcccggctgggccaatcctgtcgcttaatccgcaggaagatgtcgagtttcaaaaggaggtggcgcaggttcgcaagcgcataacccagcgaaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaaggaaagcagtgtgtaattttggattgcctgcccttggctgaaatacaggggtgcataccatcttgcagtggcttggctgacattgcctctttgtcctggcctctagttttcttttgatatttcatagctctccttagtttactctgcctggatagaaagttgaccactaactgcaggtttaagtactaaactgcagccttttctgtcgccagcaattaaagaccaccaatcttgtttgtccatctacatggtttgtcggggacatttaactcatggaggtgctttagatttcaacatcagatggttgaagctggaagtttaattatatgtagagtgagaaggcagttccagttttagcacagatttgtttatgtgttcagattttaatagagattcaaaaatgactcatttttaccaataatgttaaattagttttggttgtgctagcatgaattaataaccaccattttataccagtatcatcagtgaagaattgtatttcaagattcaaacaataaccagcaattaaacttttttctacaatgtatttgtttgcgagtagagcttgagatctccgtcgactggggatacctctaggagtca

SEQ ID NO: 290519 - DNA, 2134 bp, Homo sapiens
gggggagctgggagcccgacgtttccgggagcgccgcgtggttagcgtcggcggcttttggcatggcgactttttctggcccggctgggccaatcctgtcgcttaatccgcaggaagatgtcgagtttcaaaaggaggtggcgcaggttcgcaagcgcataacccagcgaaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggtaaaattttttttatcattttacatgcaagatattagagaaggataagtaggaaaacatattcaagactactgtagctgatcaatattcaaattgatgtgttttaaaatttattttaaggttttacgtaagaagaagaaaaaagtttcaggtactcttgacactcctgagaagactgtggatagccaggtaaaatggttttcaatactccagacaccagatattatagaaataatttgaaggaggagaagcagtttctgctactctcattttaagatttcaaattaaatattgtgacatttggtagatctttattgttgatttagcaattttctgcctaaaaccttataatggaacatgctatatttgttaattgtgaatttctgtaccaagtttgataagcatctaagttctttattctttgcaatagtatcaccaaaagatggtaacagagctaaaataatggggcacaacttgtaaaaatagaggagagatgatatttttgggtaaagtcataatcatgttttacatttatgtattataatctttacttgttgaatccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaaggaaagcagtgtgtaattttggattgcctgcccttggctgaaatacaggggtgcataccatcttgcagtggcttggctgacattgcctctttgtcctggcctctagttttcttttgatatttcatagctctccttagtttactctgcctggatagaaagttgaccactaactgcaggtttaagtactaaactgcagccttttctgtcgccagcaattaaagaccaccaatcttgtttgtccatctacatggtttgtcggggacatttaactcatggaggtgctttagatttcaacatcagatggttgaagctggaagtttaattatatgtagagtgagaaggcagttccagttttagcacagatttgtttatgtgttcagattttaatagagattcaaaaatgactcatttttaccaataatgttaaattagttttggttgtgctagcatgaattaataaccaccattttataccagtatcatcagtgaagaattgtatttcaagattcaaacaataaccagcaattaaacttttttctacaatgtatttgtttgcgagtag

SEQ ID NO: 290520 - DNA, 1288 bp, Homo sapiens
  misc_feature (1239)..(1239): n is a, c, g, or t
gggggagctgggagcccgacgtttccgggagcgccgcgtggttagcgtcggcggcttttggcatggcgactttttctggcccggctgggccaatcctgtcgcttaatccgcaggaagatgtcgagtttcaaaaggaggtggcgcaggttcgcaagcgcataacccagcgaaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggttttacgtaagaagaagaaaaaagtttcaggtactcttgacactcctgagaagactgtggatagccaggtaaaatggttttcaatactccagacaccagatattatagaaataatttgaaggaggagaagcagtttctgctactctcattttaagatttcaaattaaatattgtgacatttggtagatctttattgttgatttagcaattttctgcctaaaaccttataatggaacatgctatatttgttaattgtgaatttctgtaccaagtttgataagcatctaagttctttattctttgcaatagtatcaccaaaagatggtaacagagctaaaataatggggcacaacttgtaaaaatagaggagagatgatatttttgggtaaagtcataatcatgttttacatttatgtattataatctttacttgttgaatccagggccccacaccagtttgtacaccaacatttttggagaggcgaaaatctcaagtggctgaactgaatgatgatgataaagatgatgaaatagttttcaaacagcgtatanctcagtttttttttttgctcttattctggcacaatactatatactagcg

SEQ ID NO: 290521 - DNA, 1111 bp, Homo sapiens
gggggagctgggagcccgacgtttccgggagcgccgcgtggttagcgtcggcggcttttggcatggcgactttttctggcccggctgggccaatcctgtcgcttaatccgcaggaagatgtcgagtttcaaaaggaggtggcgcaggttcgcaagcgcataacccagcgaaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggtaaaattttttttatcattttacatgcaagatattagagaaggataagtaggaaaacatattcaagactactgtagctgatcaatattcaaattgatgtgttttaaaatttattttaaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgag

SEQ ID NO: 290522 - DNA, 3892 bp, Homo sapiens
ccgcgggcggggccggctggcgttcacgtgacccggcgtcattggctcgctcgcggaagtagtcctacattcgcggtcagcgcggggtctccgggcgccctgcagggcgggcaggctgtgccatcccgccggacgtcgggatggtgcagctgtacaacctgcacccgttcgggtcgcagcaggtggtgccctgcaagctggagccggaccggttctgtggcggggggcgtgacgcgcttttcgtggcggcgggctgcaaggtggaggcgttcgcggtggccggccaggagctgtgccagccgcggtgcgccttctccacgctgggccgggtgttgcgcctggcctacagcgaggctggagattatttggtagcaattgaagagaaaaacaaagctacatttctacgtgcttatgtgaactggagaaataaaaggactgaaaactctcgtgtgtgtatccgaatgattgggcataatgtggagggaccattcagcaaagccttcagagaccagatgtacattattgaaatgccgctttcggaggcccccttgtgcatttcctgttgccctgtgaaaggagaccttctcgttggctgcacaaataaattagtcttatttagtttgaagtaccagatcattaatgaggaattctcactattggactttgaacgttctttaattatacacatagataatatcactcctgttgaggtttctttttgtgttggatatgttgctgtcatgtcagacttagaagtcttaatcgtaaaactggagtcaggccctaaaaatggagagagagttcaccaccatccacataagaccaacaatcgaataagacggacagaagaaggcatcagtaatgaaatttcacagcttgagtcagatgattttgtcatctgccagaagcccctggaacttcttggtgaaaaaagtgaacagtctggattatctgttacactggagtctacgggattagctgatgaaaaaagaaaatattcccactttcagcacctgctctatagacgttttgctcctgatatttcgtcctatgtcttgtctgatgacatcaagctacattccctccagctgctacccatttaccagaccggttctcttacatctgatggaaaaaatttgtctcaggaaaaagaattgctgagtctcttttgctttttctccttacctcatgtgggctatctctacatggttgtcaaatctgttgaattgatgtcagtctaccagtatcctgaaaagtctcagcaggcagtactcacgccacaatttttgcacgtcattacaagtaacaacctgcagtgtttcactgtgcggtgcagtgcggcggcagctcgtgaggaggacccgtacatggacaccaccctgaaggcttgcccacctgtcagtatggatgtctgtgctttaagaatacagcttttcataggcttgaaagccatctgtcactttaaaaaccacatcatacttttgactaaagcagaacctgaagccattccagagagaagacagtcacccaagaggcttctttcgagaaaagataccagtgttaaaatcaaaatacctcctgtagctgaggctgggtggaatttgtatattgtgaatacgatctcaccagtgcagctgtacaaagagatggtagactatagcaatacctataagactgtcaaaacccagagctgcattcaccttctcagtgaggctcatctgttagtgcgagctgccctgatggatgccagtcagctggaacctggagagaaggcagagcttttggaagcatttaaggaaagctgtgggcaccttggggactgttacagcaggcttgactcccagcattctcatctcaccttgccatactataagatgtctggtttgtctatggctgaagttctggcccgcacggactggacagtagaggatggattacagaaatacgagagaggattaatcttttacattaatcattcactttatgaaaacctggatgaagaattaaatgaagaattagcagcaaaagtggttcagatgttttatgtggctgagccaaagcaagtgccccatattctctgtagtccttctatgaagaatattaatcctttaactgccatgagctatctaaggaagctggatacttctgggttttcatcgatcttagtgacattgaccaaggcagcagtggctctgaaaatgggagatcttgacatgcacagaaatgaaatgaaaagccattcagagatgaagttggtatgtggcttcattctggaacctcggctgttgattcaacagagaaagggacagattgttccaaccgagcttgcacttcacttgaaggaaactcagcctggattgcttgtggcttcagttctgggcttgcagaagaacaacaaaattggaattgaagaagcagattccttttttaaggtgctttgtgctaaggatgaagatacaattcctcagctcttggtagacttttgggaagctcagctagtggcatgtctcccagatgtggtacttcaggaactctttttcaaactcacatcacagtacatctggagattgtctaagaggcagcctcctgacaccacaccattgcgaacatcggaggatctgataaatgcctgtagtcattatggcttaatttatccatgggttcacgtcgtaatatcatctgattctttagctgataaaaattatacagaagatctttcaaaattacagtctcttatatgtggtccttcatttgacatagcttccattattccgttcttggagccactttcagaagacactattgccggcctcagtgtccatgttctgtgtcgtacacgcttgaaagagtatgaacagtgcatagacatactgttagagagatgcccggaggcagtcattccatatgctaatcatgaactgaaagaagagaaccggactctgtggtggaaaaaactgttgcctgaactttgtcagagaataaaatgtggtggagagaagtatcaactctacctgtcatcattaaaagaaacattgtcaattgttgctgtggaactagaactgaaggatttcatgaatgttctcccagaagatggtactgcaacatttttcttgccatatcttctctattgcagtcgaaagaaaccattgacttaaaggtatcatttgaaaaataccataatggcatttgagactgaatttctaaaaattgaatgccaaagtacaagtagaggagttttttattttatatatcacacacacacacacacacacacacacacacacacacatatatgatacaaatgctttcaggctgcttaccttaccgtgtagtggtaactattcacttcttaatttatgacctcaatcaatttaattgtctagaatgtaaaaagtctttaagacataagaattcctcaaagaagccatacattttttaaggtggggattgacttttattccaaggaacaacatcagttcactgttgttggagacatgacaatcattttcatcccaagaacactttaaggaaacattttacaagtatgcttgaaagaatgtcactaactggtccagaattttatcttcttgatttttccagatttctctatgtttttgagaaagatgttaatgttttgccatggtaaaagatttcaaacctcattttttttgttccttttcttgttacttttaagaaaactcatgctctgtttctctgaatcaaatgaagtagaagtttacaaagctaactttcttcttgtctagctattaacatgatttgtcaaatgcatgtttttttcagccaaagccttgtttccatttttgttgatgtgtactcttgctcttttagctagagtgtatgtgaaaataaagaaatacatcattgtattcac

SEQ ID NO: 290523 - DNA, 988 bp, Homo sapiens
ccgcgggcggggccggctggcgttcacgtgacccggcgtcattggctcgctcgcggaagtagtcctacattcgcggtcagcgcggggtctccgggcgccctgcagggcgggcaggctgtgccatcccgccggacgtcgggatggtgcagctgtacaacctgcacccgttcgggtcgcagcaggtggtgccctgcaagctggagccggaccggttctgtggcggggggcgtgacgcgcttttcgtggcggcgggctgcaaggtggaggcgttcgcggtggccggccaggagctgtgccagccgcggtgcgccttctccacgctgggccgggtgttgcgcctggcctacagcgaggctggcatcagtaatgaaatttcacagcttgagtcagatgattttgtcatctgccagaagcccctggaacttcttggtgaaaaaagtgaacagtctggattatctgttacactggagtctacgggattagctgatgaaaaaagaaaatattcccactttcagcacctgctctatagacgttttgctcctgatatttcgtcctatgtcttgtctgatgacatcaagctacattccctccagctgctacccatttaccagaccggttctcttacatctgatggaaaaaatttgtctcaggaaaaagaattgctgagtctcttttgctttttctccttacctcatgtgggctatctctacatggttgtcaaatctgttgaattgatgtcagtctaccagtatcctgaaaagtctcagcaggcagtactcacgccacaatttttgcacgtcattacaagtaacaacctgccgggtgtcccgtgcgcgcacagtcggcgggaccccttgagcggaactcgctcttgttgccccctgtagggtttcccccgctgcctgcgggtctgcgccacaaaacacgtttctacgcttatacccctttgcgtttataacccttactttgcgtcagccacgttagacct

SEQ ID NO: 290524 - DNA, 3964 bp, Homo sapiens
ccgcgggcggggccggctggcgttcacgtgacccggcgtcattggctcgctcgcggaagtagtcctacattcgcggtcagcgcggggtctccgggcgccctgcagggcgggcaggctgtgccatcccgccggacgtcgggatggtgcagctgtacaacctgcacccgttcgggtcgcagcaggtggtgccctgcaagctggagccggaccggttctgtggcggggggcgtgacgcgcttttcgtggcggcgggctgcaaggtggaggcgttcgcggtggccggccaggagctgtgccagccgcggtgcgccttctccacgctgggccgggtgttgcgcctggcctacagcgaggctggagattatttggtagcaattgaagagaaaaacaaagctacatttctacgtgcttatgtgaactggagaaataaaaggactgaaaactctcgtgtgtgtatccgaatgattgggcataatgtggagggaccattcagcaaagccttcagagaccagatgtacattattgaaatgccgctttcggaggcccccttgtgcatttcctgttgccctgtgaaaggagaccttctcgttggctgcacaaataaattagtcttatttagtttgaagtaccagatcattaatgaggaattctcactattggactttgaacgttctttaattatacacatagataatatcactcctgttgaggtttctttttgtgttggatatgttgctgtcatgtcagacttagaagtcttaatcgtaaaactggagtcaggccctaaaaatggagagagagttcaccaccatccacataagaccaacaatcgaataagacggacagaagaaggcatcagtaatgaaatttcacagcttgagtcagatgattttgtcatctgccagaagcccctggaacttcttggtgaaaaaagtgaacagtctggattatctgttacactggagtctacgggattagctgatgaaaaaagaaaatattcccactttcagcacctgctctatagacgttttgctcctgatatttcgtcctatgtcttgtctgatgacatcaagctacattccctccagctgctacccatttaccagaccggttctcttacatctgatggaaaaaatttgtctcaggaaaaagaattgctgagtctcttttgctttttctccttacctcatgtgggctatctctacatggttgtcaaatctgttgaattgatgtcagtctaccagtatcctgaaaagtctcagcaggcagtactcacgccacaatttttgcacgtcattacaagtaacaacctgcagtgtttcactgtgcggtgcagtgcggcggcagctcgtgaggaggacccgtacatggacaccaccctgaaggcttgcccacctgtcagtatggatgtctgtgctttaagaatacagcttttcataggcttgaaagccatctgtcactttaaaaaccacatcatacttttgactaaagcagaacctgaagccattccagagagaagacagtcacccaagaggcttctttcgagaaaagataccagtgttaaaatcaaaatacctcctgtagctgaggctgggtggaatttgtatattgtgaatacgatctcaccagtgcagctgtacaaagagatggtagactatagcaatacctataagactgtcaaaacccagagctgcattcaccttctcagtgaggctcatctgttagtgcgagctgccctgatggatgccagtcagctggaacctggagagaaggcagagcttttggaagcatttaaggaaagctgtgggcaccttggggactgttacagcaggcttgactcccagcattctcatctcaccttgccatactataagatgtctggtttgtctatggctgaagttctggcccgcacggactggacagtagaggatggattacagaaatacgagagaggattaatcttttacattaatcattcactttatgaaaacctggatgaagaattaaatgaagaattagcagcaaaagtggttcagatgttttatgtggctgagccaaagcaagtgccccatattctctgtagtccttctatgaagaatattaatcctttaactgccatgagctatctaaggaagctggatacttctgggttttcatcgatcttagtgacattgaccaaggcagcagtggctctgaaaatgggagatcttgacatgcacagaaatgaaatgaaaagccattcagagatgaagttggtatgtggcttcattctggaacctcggctgttgattcaacagagaaagggacagattgttccaaccgagcttgcacttcacttgaaggaaactcagcctggattgcttgtggcttcagttctgggcttgcagaagaacaacaaaattggaattgaagaagcagattccttttttaaggtgctttgtgctaaggatgaagatacaattcctcagctcttggtagacttttgggaagctcagctagtggcatgtctcccagatgtggtacttcaggaactctttttcaaactcacatcacagtacatctggagattgtctaagaggcagcctcctgacaccacaccattgcgaacatcggaggatctgataaatgcctgtagtcattatggcttaatttatccatgggttcacgtcgtaatatcatctgattctttagctgataaaaattatacagaagatctttcaaaattacagcttccattattccgttcttggagccactttcagaagacactattgccggcctcagtgtccatgttctgtgtcgtacacgcttgaaagagtatgaacagtgcatagacatactgttagagagatgcccggaggcagtcattccatatgctaatcatgaactgaaagaagagaaccggactctgtggtggaaaaaactgttgcctgaactttgtcagagaataaaatgtggtggagagaagtatcaactctacctgtcatcattaaaagcttaattttcacgggaactgtggaagctagcagacagtaccactacattataaatgaggaacctaggacttggaagattaagtgactttcttaaagccactcgaaacattgtcaattgttgctgtggaactagaactgaaggatttcatgaatgttctcccagaagatggtactgcaacatttttcttgccatatcttctctattgcagtcgaaagaaaccattgacttaaaggtatcatttgaaaaataccataatggcatttgagactgaatttctaaaaattgaatgccaaagtacaagtagaggagttttttattttatatatcacacacacacacacacacacacacacacacacacacatatatgatacaaatgctttcaggctgcttaccttaccgtgtagtggtaactattcacttcttaatttatgacctcaatcaatttaattgtctagaatgtaaaaagtctttaagacataagaattcctcaaagaagccatacattttttaaggtggggattgacttttattccaaggaacaacatcagttcactgttgttggagacatgacaatcattttcatcccaagaacactttaaggaaacattttacaagtatgcttgaaagaatgtcactaactggtccagaattttatcttcttgatttttccagatttctctatgtttttgagaaagatgttaatgttttgccatggtaaaagatttcaaacctcattttttttgttccttttcttgttacttttaagaaaactcatgctctgtttctctgaatcaaatgaagtagaagtttacaaagctaactttcttcttgtctagctattaacatgatttgtcaaatgcatgtttttttcagccaaagccttgtttccatttttgttgatgtgtactcttgctcttttagctagagtgtatgtgaaaataaagaaatacatcattgtattcac

SEQ ID NO: 290525 - DNA, 3361 bp, Homo sapiens
ccgcgggcggggccggctggcgttcacgtgacccggcgtcattggctcgctcgcggaagtagtcctacattcgcggtcagcgcggggtctccgggcgccctgcagggcgggcaggctgtgccatcccgccggacgtcgggatggtgcagctgtacaacctgcacccgttcgggtcgcagcaggtggtgccctgcaagctggagccggaccggttctgtggcggggggcgtgacgcgcttttcgtggcggcgggctgcaaggtggaggcgttcgcggtggccggccaggagctgtgccagccgcggtgcgccttctccacgctgggccgggtgttgcgcctggcctacagcgaggctggcatcagtaatgaaatttcacagcttgagtcagatgattttgtcatctgccagaagcccctggaacttcttggtgaaaaaagtgaacagtctggattatctgttacactggagttacattccctccagctgctacccatttaccagaccggttctcttacatctgatggaaaaaatttgtctcaggaaaaagaattgctgagtctcttttgctttttctccttacctcatgtgggctatctctacatggttgtcaaatctgttgaattgatgtcagtctaccagtatcctgaaaagtctcagcaggcagtactcacgccacaatttttgcacgtcattacaagtaacaacctgcagtgtttcactgtgcggtgcagtgcggcggcagctcgtgaggaggacccgtacatggacaccaccctgaaggcttgcccacctgtcagtatggatgtctgtgctttaagaatacagcttttcataggcttgaaagccatctgtcactttaaaaaccacatcatacttttgactaaagcagaacctgaagccattccagagagaagacagtcacccaagaggcttctttcgagaaaagataccagtgttaaaatcaaaatacctcctgtagctgaggctgggtggaatttgtatattgtgaatacgatctcaccagtgcagctgtacaaagagatggtagactatagcaatacctataagactgtcaaaacccagagctgcattcaccttctcagtgaggctcatctgttagtgcgagctgccctgatggatgccagtcagctggaacctggagagaaggcagagcttttggaagcatttaaggaaagctgtgggcaccttggggactgttacagcaggcttgactcccagcattctcatctcaccttgccatactataagatgtctggtttgtctatggctgaagttctggcccgcacggactggacagtagaggatggattacagaaatacgagagaggattaatcttttacattaatcattcactttatgaaaacctggatgaagaattaaatgaagaattagcagcaaaagtggttcagatgttttatgtggctgagccaaagcaagtgccccatattctctgtagtccttctatgaagaatattaatcctttaactgccatgagctatctaaggaagctggatacttctgggttttcatcgatcttagtgacattgaccaaggcagcagtggctctgaaaatgggagatcttgacatgcacagaaatgaaatgaaaagccattcagagatgaagttggtatgtggcttcattctggaacctcggctgttgattcaacagagaaagggacagattgttccaaccgagcttgcacttcacttgaaggaaactcagcctggattgcttgtggcttcagttctgggcttgcagaagaacaacaaaattggaattgaagaagcagattccttttttaaggtgctttgtgctaaggatgaagatacaattcctcagctcttggtagacttttgggaagctcagctagtggcatgtctcccagatgtggtacttcaggaactctttttcaaactcacatcacagtacatctggagattgtctaagaggcagcctcctgacaccacaccattgcgaacatcggaggatctgataaatgcctgtagtcattatggcttaatttatccatgggttcacgtcgtaatatcatctgattctttagctgataaaaattatacagaagatctttcaaaattacagcttccattattccgttcttggagccactttcagaagacactattgccggcctcagtgtccatgttctgtgtcgtacacgcttgaaagagtatgaacagtgcatagacatactgttagagagatgcccggaggcagtcattccatatgctaatcatgaactgaaagaagagaaccggactctgtggtggaaaaaactgttgcctgaactttgtcagagaataaaatgtggtggagagaagtatcaactctacctgtcatcattaaaagcttaattttcacgggaactgtggaagctagcagacagtaccactacattataaatgaggaacctaggacttggaagattaagtgactttcttaaagccactcgaaacattgtcaattgttgctgtggaactagaactgaaggatttcatgaatgttctcccagaagatggtactgcaacatttttcttgccatatcttctctattgcagtcgaaagaaaccattgacttaaaggtatcatttgaaaaataccataatggcatttgagactgaatttctaaaaattgaatgccaaagtacaagtagaggagttttttattttatatatcacacacacacacacacacacacacacacacacacacatatatgatacaaatgctttcaggctgcttaccttaccgtgtagtggtaactattcacttcttaatttatgacctcaatcaatttaattgtctagaatgtaaaaagtctttaagacataagaattcctcaaagaagccatacattttttaaggtggggattgacttttattccaaggaacaacatcagttcactgttgttggagacatgacaatcattttcatcccaagaacactttaaggaaacattttacaagtatgcttgaaagaatgtcactaactggtccagaattttatcttcttgatttttccagatttctctatgtttttgagaaagatgttaatgttttgccatggtaaaagatttcaaacctcattttttttgttccttttcttgttacttttaagaaaactcatgctctgtttctctgaatcaaatgaagtagaagtttacaaagctaactttcttcttgtctagctattaacatgatttgtcaaatgcatgtttttttcagccaaagccttgtttccatttttgttgatgtgtactcttgctcttttagctagagtgtatgtgaaaataaagaaatacatcattgtattcac

SEQ ID NO: 290526 - DNA, 2149 bp, Homo sapiens
cgaagtattggatatcgtcgaccacgcgctccgctcatctcaccttgccatactataagatgtctggtttgtctatggctgaagttctggcccgcacggactggacagtagaggatggattacagaaatacgagagaggattaatcttttacattaatcattcactttatgaaaacctggatgaagaattaaatgaagaattagcagcaaaagtggttcagatgttttatgtggctgagccaaagcaagtgccccatattctctgtagtccttctatgaagaatattaatcctttaactgccatgagctatctaaggaagctggatacttctgggttttcatcgatcttagtgacattgaccaaggcagcagtggctctgaaaatgggagatcttgacatgcacagaaatgaaatgaaaagccattcagagatgaagttggtatgtggcttcattctggaacctcggctgttgattcaacagagaaagggacagattgttccaaccgagcttgcacttcacttgaaggaaactcagcctggattgcttgtggcttcagttctgggcttgcagaagaacaacaaaattggaattgaagaagcagattccttttttaaggtgctttgtgctaaggatgaagatacaattcctcagctcttggtagacttttgggaagctcagctagtggcatgtctcccagatgtggtacttcaggaactctttttcaaactcacatcacagtacatctggagattgtctaagaggcagcctcctgacaccacaccattgcgaacatcggaggatctgataaatgcctgtagtcattatggcttaatttatccatgggttcacgtcgtaatatcatctgattctttagctgataaaaattatacagaagatctttcaaaattacagcttccattattccgttcttggagccactttcagaagacactattgccggcctcagtgtccatgttctgtgtcgtacacgcttgaaagagtatgaacagtgcatagacatactgttagagagatgcccggaggcagtcattccatatgctaatcatgaactgaaagaagagaaccggactctgtggtggaaaaaactgttgcctgaactttgtcagagaataaaatgtggtggagagaagtatcaactctacctgtcatcattaaaagcttaattttcacgggaactgtggaagctagcagacagtaccactacattataaatgaggaacctaggacttggaagattaagtgactttcttaaagccactcgaaacattgtcaattgttgctgtggaactagaactgaaggatttcatgaatgttctcccagaagatggtactgcaacatttttcttgccatatcttctctattgcagtcgaaagaaaccattgacttaaaggtatcatttgaaaaataccataatggcatttgagactgaatttctaaaaattgaatgccaaagtacaagtagaggagttttttattttatatatcacacacacacacacacacacacacacacacacacacatatatgatacaaatgctttcaggctgcttaccttaccgtgtagtggtaactattcacttcttaatttatgacctcaatcaatttaattgtctagaatgtaaaaagtctttaagacataagaattcctcaaagaagccatacattttttaaggtggggattgacttttattccaaggaacaacatcagttcactgttgttggagacatgacaatcattttcatcccaagaacactttaaggaaacattttacaagtatgcttgaaagaatgtcactaactggtccagaattttatcttcttgatttttccagatttctctatgtttttgagaaagatgttaatgttttgccatggtaaaagatttcaaacctcattttttttgttccttttcttgttacttttaagaaaactcatgctctgtttctctgaatcaaatgaagtagaagtttacaaagctaactttcttcttgtctagctattaacatgatttgtcaaatgcatgtttttttcagccaaagccttgtttccatttttgttgatgtgtactcttgctcttttagctagagtgtatgtgaaaataaagaaatacatcattgtattcac

SEQ ID NO: 290527 - DNA, 3522 bp, Homo sapiens
  misc_feature (3437)..(3437): n is a, c, g, or t
ccgcgggcggggccggctggcgttcacgtgacccggcgtcattggctcgctcgcggaagtagtcctacattcgcggtcagcgcggggtctccgggcgccctgcagggcgggcaggctgtgccatcccgccggacgtcgggatggtgcagctgtacaacctgcacccgttcgggtcgcagcaggtggtgccctgcaagctggagccggaccggttctgtggcggggggcgtgacgcgcttttcgtggcggcgggctgcaaggtggaggcgttcgcggtggccggccaggagctgtgccagccgcggtgcgccttctccacgctgggccgggtgttgcgcctggcctacagcgaggctggagattatttggtagcaattgaagagaaaaacaaagctacatttctacgtgcttatgtgaactggagaaataaaaggactgaaaactctcgtgtgtgtatccgaatgattgggcataatgtggagggaccattcagcaaagccttcagagaccagatgtacattattgaaatgccgctttcggaggcccccttgtgcatttcctgttgccctgtgaaaggagaccttctcgttggctgcacaaataaattagtcttatttagtttgaagtaccagatcattaatgaggaattctcactattggactttgaacgttctttaattatacacatagataatatcactcctgttgaggtttctttttgtgttggatatgttgctgtcatgtcagacttagaagtcttaatcgtaaaactggagtcaggccctaaaaatggagagagagttcaccaccatccacataagaccaacaatcgaataagacggacagaagaaggcatcagtaatgaaatttcacagcttgagtcagatgattttgtcatctgccagaagcccctggaacttcttggtgaaaaaagtgaacagtctggattatctgttacactggagtctacgggattagctgatgaaaaaagaaaatattcccactttcagcacctgctctatagacgttttgctcctgatatttcgtcctatgtcttgtctgatgacatcaagctacattccctccagctgctacccatttaccagaccggttctcttacatctgatggaaaaaatttgtctcaggaaaaagaattgctgagtctcttttgctttttctccttacctcatgtgggctatctctacatggttgtcaaatctgttgaattgatgtcagtctaccagtatcctgaaaagtctcagcaggcagtactcacgccacaatttttgcacgtcattacaagtaacaacctgcagtgtttcactgtgcggtgcagtgcggcggcagctcgtgaggaggacccgtacatggacaccaccctgaaggcttgcccacctgtcagtatggatgtctgtgctttaagaatacagcttttcataggcttgaaagccatctgtcactttaaaaaccacatcatacttttgactaaagcagaacctgaagccattccagagagaagacagtcacccaagaggcttctttcgagaaaagataccagtgttaaaatcaaaatacctcctgtagctgaggctgggtggaatttgtatattgtgaatacgatctcaccagtgcagctgtacaaagagatggtagactatagcaatacctataagactgtcaaaacccagagctgcattcaccttctcagtgaggctcatctgttagtgcgagctgccctgatggatgccagtcagctggaacctggagagaaggcagagcttttggaagcatttaaggaaagctgtgggcaccttggggactgttacagcaggcttgactcccagcattctcatctcaccttgccatactataagatgtctggtttgtctatggctgaagttctggcccgcacggactggacagtagaggatggattacagaaatacgagagaggattaatcttttacattaatcattcactttatgaaaacctggatgaagaattaaatgaagaattagcagcaaaagtggttcagatgttttatgtggctgagccaaagcaagtgccccatattctctgtagtccttctatgaagaatattaatcctttaactgccatgagctatctaaggaagctggatacttctgggttttcatcgatcttagtgacattgaccaaggcagcagtggctctgaaaatgggagatcttgacatgcacagaaatgaaatgaaaagccattcagagatgaagttggtatgtggcttcattctggaacctcggctgttgattcaacagagaaagggacagattgttccaaccgagcttgcacttcacttgaaggaaactcagcctggattgcttgtggcttcagttctgggcttgcagaagaacaacaaaattggaattgaagaagcagattccttttttaaggtgctttgtgctaaggatgaagatacaattcctcagctcttggtagacttttgggaagctcagctagtggcatgtctcccagatgtggtacttcaggaactctttttcaaactcacatcacagtacatctggagattgtctaagaggcagcctcctgacaccacaccattgcgaacatcggaggatctgataaatgcctgtagtcattatggcttaatttatccatgggttcacgtcgtaatatcatctgattctttagctgataaaaattatacagaagatctttcaaaattacagtctcttatatgtggtccttcatttgacatagcttccattattccgttcttggagccactttcagaagacactattgccggcctcagtgtccatgttctgtgtcgtacacgcttgaaagagtatgaacagtgcatagacatactgttagagagatgcccggaggcagtcattccatatgctaatcatgaactgaaagaagagaaccggactctgtggtggaaaaaactgttgcctgaactttgtcagagaataaaatgtggtggagagaagtatcaactctacctgtcatcattaaaagaaacattgtcaattgttgctgtggaactagaactgaaggatttcatgaatgttctcccagaagatggtactgcaacatttttcttgccatatcttctctattgcagtcgaaagaaaccattgacttaaaggtatcatttgaaaaataccataatggcatttgagactgaatttctaaaaattgaatgccaaagtacaagtagaggagttttttattttatatatcacacacacacacacacacacacacacacacacacacatatatgatacaaatgctttcaggctgcttaccttaccgtgtagtggtaactattcacttcttaatttatgacctcaatcaatttaattgtctagaatgtaaaaagtctttaagacataagaattcctcaaagaagccatacattttangggggagcgcctttattccgggaacacctcggtcctggggggggacatgacaccttttctccagacctggggacttcacgttggg

SEQ ID NO: 290528 - DNA, 3370 bp, Homo sapiens
ccgcgggcggggccggctggcgttcacgtgacccggcgtcattggctcgctcgcggaagtagtcctacattcgcggtcagcgcggggtctccgggcgccctgcagggcgggcaggctgtgccatcccgccggacgtcgggatggtgcagctgtacaacctgcacccgttcgggtcgcagcaggtggtgccctgcaagctggagccggaccggttctgtggcggggggcgtgacgcgcttttcgtggcggcgggctgcaaggtggaggcgttcgcggtggccggccaggagctgtgccagccgcggtgcgccttctccacgctgggccgggtgttgcgcctggcctacagcgaggctggagattatttggtagcaattgaagagaaaaacaaagctacatttctacgtgcttatgtgaactggagaaataaaaggactgaaaactctcgtgtgtgtatccgaatgattgggcataatgtggagggaccattcagcaaagccttcagagaccagatgtacattattgaaatgccgctttcggaggcccccttgtgcatttcctgttgccctgtgaaaggagaccttctcgttggctgcacaaataaattagtcttatttagtttgaagtaccagatcattaatgaggaattctcactattggactttgaacgttctttaattatacacatagataatatcactcctgttgaggtttctttttgtgttggatatgttgctgtcatgtcagacttagaagtcttaatcgtaaaactggagtcaggccctaaaaatggagagagagttcaccaccatccacataagaccaacaatcgaataagacggacagaagaaggcatcagtaatgaaatttcacagcttgagtcagatgattttgtcatctgccagaagcccctggaacttcttggtgaaaaaagtgaacagtctggattatctgttacactggagtctacgggattagctgatgaaaaaagaaaatattcccactttcagcacctgctctatagacgttttgctcctgatatttcgtcctatgtcttgtctgatgacatcaagctacattccctccagctgctacccatttaccagaccggttctcttacatctgatggaaaaaatttgtctcaggaaaaagaattgctgagtctcttttgctttttctccttacctcatgtgggctatctctacatggttgtcaaatctgttgaattgatgtcagtctaccagtatcctgaaaagtctcagcaggcagtactcacgccacaatttttgcacgtcattacaagtaacaacctgcagtgtttcactgtgcggtgcagtgcggcggcagctcgtgaggaggacccgtacatggacaccaccctgaaggcttgcccacctgtcagtatggatgtctgtgctttaagaatacagcttttcataggcttgaaagccatctgtcactttaaaaaccacatcatacttttgactaaagcagaacctgaagccattccagagagaagacagtcacccaagaggcttctttcgagaaaagataccagtgttaaaatcaaaatacctcctgtagctgaggctgggtggaatttgtatattgtgaatacgatctcaccagtgcagctgtacaaagagatggtagactatagcaatacctataagactgtcaaaacccagagctgcattcaccttctcagtgaggctcatctgttagtgcgagctgccctgatggatgccagtcagctggaacctggagagaaggcagagcttttggaagcatttaaggaaagctgtgggcaccttggggactgttacagcaggcttgactcccagcattctcatctcaccttgccatactataagatgtctggtttgtctatggctgaagttctggcccgcacggactggacagtagaggatggattacagaaatacgagagaggattaatcttttacattaatcattcactttatgaaaacctggatgaagaattaaatgaagaattagcagcaaaagtggttcagatgttttatgtggctgagccaaagcaagtgccccatattctctgtagtccttctatgaagaatattaatcctttaactgccatgagctatctaaggaagctggatacttctgggttttcatcgatcttagtgacattgaccaaggcagcagtggctctgaaaatgggagatcttgacatgcacagaaatgaaatgaaaagccattcagagatgaagttggtatgtggcttcattctggaacctcggctgttgattcaacagagaaagggacagattgttccaaccgagcttgcacttcacttgaaggaaactcagcctggattgcttgtggcttcagttctgggcttgcagaagaacaacaaaattggaattgaagaagcagattccttttttaaggtgctttgtgctaaggatgaagatacaattcctcagctcttggtagacttttgggaagctcagctagtggcatgtctcccagatgtggtacttcaggaactctttttcaaactcacatcacagtacatctggagattgtctaagaggcagcctcctgacaccacaccattgcgaacatcggaggatctgataaatgcctgtagtcattatggcttaatttatccatgggttcacgtcgtaatatcatctgattctttagctgataaaaattatacagaagatctttcaaaattacagtctcttatatgtggtccttcatttgacatagcttccattattccgttcttggagccactttcagaagacactattgccggcctcagtgtccatgttctgtgtcgtacacgcttgaaagagtatgaacagtgcatagacatactgttagagagatgcccggaggcagtcattccatatgctaatcatgaactgaaagaagagaaccggactctgtggtggaaaaaactgttgcctgaactttgtcagagaataaaatgtggtggagagaagtatcaactctacctgtcatcattaaaagaaacattgtcaattgttgctgtggaactagaactgaaggatttcaccacatctatacagttcattccatcgtcaacatctaaaacaatgctgaaacagagcaagctttccagtcttactttacgagcaaaatcaagatctacatactacaactttcacttacgtttctccatctaacccatcctctctttcaataactgtaactgttggattgaagaactgcatcttggaatacattgccctgtcttaagataataactactaactcagtatatcaccatgcaataaaggacagtccaacatccgactatcactcaggacagttactctaccaagacttcata

SEQ ID NO: 290529 - DNA, 2031 bp, Homo sapiens
ccgcgggcggggccggctggcgttcacgtgacccggcgtcattggctcgctcgcggaagtagtcctacattcgcggtcagcgcggggtctccgggcgccctgcagggcgggcaggctgtgccatcccgccggacgtcgggatggtgcagctgtacaacctgcacccgttcgggtcgcagcaggtggtgccctgcaagctggagccggaccggttctgtggcggggggcgtgacgcgcttttcgtggcggcgggctgcaaggtggaggcgttcgcggtggccggccaggagctgtgccagccgcggtgcgccttctccacgctgggccgggtgttgcgcctggcctacagcgaggctggagattatttggtagcaattgaagagaaaaacaaagctacatttctacgtgcttatgtgaactggagaaataaaaggactgaaaactctcgtgtgtgtatccgaatgattgggcataatgtggagggaccattcagcaaagccttcagagaccagatgtacattattgaaatgccgctttcggaggcccccttgtgcatttcctgttgccctgtgaaaggagaccttctcgttggctgcacaaataaattagtcttatttagtttgaagtaccagatcattaatgaggaattctcactattggactttgaacgttctttaattatacacatagataatatcactcctgttgaggtttctttttgtgttggatatgttgctgtcatgtcagacttagaagtcttaatcgtaaaactggagtcaggccctaaaaatggagagagagttcaccaccatccacataagaccaacaatcgaataagacggacagaagaaggcatcagtaatgaaatttcacagcttgagtcagatgattttgtcatctgccagaagcccctggaacttcttggtgaaaaaagtgaacagtctggattatctgttacactggagtctacgggattagctgatgaaaaaagaaaatattcccactttcagcacctgctctatagacgttttgctcctgatatttcgtcctatgtcttgtctgatgacatcaagctacattccctccagctgctacccatttaccagaccggttctcttacatctgatggaaaaaatttgtctcaggaaaaagaattgctgagtctcttttgctttttctccttacctcatgtgggctatctctacatggttgtcaaatctgttgaattgatgtcagtctaccagtatcctgaaaagtctcagcaggcagtactcacgccacaatttttgcacgtcattacaagtaacaacctgcagtgtttcactgtgcggtgcagtgcggcggcagctcgtgaggaggacccgtacatggacaccaccctgaaggcttgcccacctgtcagtatggatgtctgtgctttaagaatacagcttttcataggcttgaaagccatctgtcactttaaaaaccacatcatacttttgactaaagcagaacctgaagccattccagagagaagacagtcacccaagaggcttctgtaagcatccccttgccccaggcattcctgccagtttctggaatgagttgtaactggtatattttgtgtttatcttttttcaaatcataacttggaatgatcaaatggcttttttatggtggtctttttccagagaaagaaaagaaggttctaacaatctctgtaatacactttataactgacctggaaacttttaggagaaaatggattataaaatagtttcagtaaaaatcaaaggtgttttagattagttaaaggccatgcttttctgtgtaattaatgagaaagactgagcctataatgctaattgaaactacaggactttttactgtctttcttctttgaccctttcagttgttacatttttatctaaaattattttctgatattatgaaagaaattaataatgtatgtcttaccttaaagcacatttatgatctatagatatgtgctcatgtatctgaaaataaagttgtattttgataacattc

SEQ ID NO: 290530 - DNA, 192 bp, Homo sapiens
accacagggattctgaggcattcctcttattgagaagaagtttaacttggcaatatttgacaaatacttgactgtcacccctgcccattgccctgtttgcctgtgaaaccctccctgctgtgggtatgttggttcttggcctcactttgctcagcagcctgtgtcttcctcctcagtaacaacctgcagtgt

SEQ ID NO: 290531 - DNA, 718 bp, Homo sapiens
tgggattacagcgtgagcaccacgcctgcctgaactggctctaattggttggttaagtaagaagagattgaatgaaagacagactttcaattctaattcagatattcttttctacacagaaacattgtcaattgttgctgtggaactagaactgaaggatttcatgaatgttctcccagaagatggtactgcaacatttttcttgccatatcttctctattgcagtcgaaagaaaccattgacttaaaggtatcatttgaaaaataccataatggcatttgagactgaatttctaaaaattgaatgccaaagtacaagtagaggagttttttattttatatatcacacacacacacacacacacacacacacacacacacatatatgatacaaatgctttcaggctgcttaccttaccgtgtagtggtaactattcacttcttaatttatgacctcaatcaatttaattgtctagaatgtaaaaagtctttaagacataagaattcctcaaagaagccatacattttttaaggtggggattgacttttattccaaggaacaacatcagttcactgttgttggagacatgacaatcattttcatcccaagaacactttaaggaaacattttacaagtatgcttgaaagaatgtcactaactggtccagaattttatcttcttgatttttccagatttctctatgtttttgagaaagatg

SEQ ID NO: 290532 - DNA, 289 bp, Homo sapiens
gtcttttcacaaccacagtgccttgtaaatgtgtgcatattataaataaatgaaattactatatgtctaattggtgagaggatgttgtaaaatctaattttcattcaagcaggactgttacattttatttttttaaggcatcagtaatgaaatttcacagcttgagtcagatgattttgtcatctgccagaagcccctggaacttcttggtgaaaaaagtgaacagtctggattatctgttacactggagtctacgggattagctgatgaaaaaagaaaatattcccac

SEQ ID NO: 290533 - DNA, 1756 bp, Homo sapiens
ttcaaaatcttctcaggcacactgatacacatacctcagatttttaattctccggttgtgttcaccaggtgcttggtcatgattaagaattccgtgatgtgtaccccatgtgtttaaatttgctgctgagttaactttgtggcggcctgtggactagacctctgcacatgcaatgcagaacggcagggccagatttgaaatcctgctatcttttcggctgccttgtaaaaataacatcaggcgatggggatacgatgccagaggtcacctgtgataagttctgtttatggccattttacttctaggaagacaggaagtgtcaggatctcagggatctaggaagccaaaatgtttttccactctgaaataaagtgactgaccaggagttcccggccacgcagccctgtgggaactgccgcacggccacttttatgaagtggacacgtgttggtcccactgaaaagaaactccccacccatggctccctcacgctgcagcagaggccctgccacagcacctgtcagcccctgccagcttgcaggggcgcaggcgcagagcggtttgtgcccttgctggagccagggaagggcacagggtccctcctggagtcatgggaggtgcagccgaggttctatattaaaatacagaggctagcacatgtgcttggggaatgcagctacagtagtggaatgaaagtgctgtccgttccttacccccccagcttctcacctgtcctccacacgcatatccctggctccctttccctagtaaggagactgaattgaaattgtggcttgcccgaggctgcatacctgtgctctttctgaagcccaagtcactggctctagaattctaacctgtgaggaagccactgaggatgtttgtcaaaatacatatttctgtgccttgccccagttccacggcccaggaatctgcagttttcacaagcacccccaggtgattctggtggtgtctttgcacttcttcaaggcagtactgcctggaacgcagaatcccagcctcctctatcctccttgcctaatggcctggatgctctcagatctacaggggaagggaaggtcacacagtcatcgcaatagtaacctcagctgataaatcctcccccataaaacttattccccagtgttttttaataggaaacaataaaactgtaaccagcccaaatatccatcaaagagaaaatggagaagtaaatcatcgcacattcacctggaccagatctattgtaaagccaataatactgaagccccttccaaggccctgggagtcctaacagtgcactggcagtgtctataatttatattatgaaatttgcataaggaaaacattttgtctcatttgtgcaatttctccttctaaatatacgtgtcactttgtacctgatttctataagacccaggacctacaaaccctgtgtctgcccctgcagccacccagggaaggactgcacagcagcaagacagattgccatggagcatgttgtgcccaactagggacagcgcagatagattctgtaatttgcctaacaatgtctataggatgatcccatttgtcaaaaaaaaaaaagaactgggctttattgatgtcacctaaatgcacctaaacttcttttttgccccatgctcttctgtactcttgatctttccccaaatttttaaaaacatgacactcattcccttatttttcctacttagaaaagtgtagatggttttatcataggaagttcaaaaaaatt

SEQ ID NO: 290534 - DNA, 1627 bp, Homo sapiens
gtcctaggctgggacccgggctgtccgccagggctgggagacactggaggaggccggccgatgattacgcgcgatgccaacgacgactgccctacggtggaccgcggctgcccgtgtgcggaggaaagggagaggcggctgggtgccggctgcgctgcggtccgtgagccaggacagagtcccaggctgtacagtgatgggcggagagactcgcagtcctgagaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaatataa

SEQ ID NO: 290535 - DNA, 1540 bp, Homo sapiens
tacacgcctgtagtccaagtgacttgggaggctgaggtaggaggatcacttgagccctggaggttcaggctgcagtgatctgtgattgtgaaccgtgatcctgccaggcactccagcctgggcaacacagagagaatttctctcaaaataaataaataaagtttatgtcctagatggataatattaggtaattttatttgcagtacattcttcaatagctactctttttactgctaacactatggtttacataagaatattaacatataaagtttcgtaatttgtgttctgagttataacagtagtaagcattaaagaattttatgactttttattttcaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaatataa

SEQ ID NO: 290536 - DNA, 356 bp, Homo sapiens
cacttgctaacaatgtagattccagggtcctagtcccataaattctgattcaggtctaatattgaggcctggcaatctgcattgtcaacaatgcagcttatcctgaagtgggtaatctgggaatatcctttgaaaaacactgaaatagactaccaacatctatgaaaacatttacgggtgcttaaatttcaggatgtttcttttctttctccccatttcctctcatccattatgcatgaaagacttctgcaagatgccaagaggggaacttgggctttttcttttttccaatttgccttttacagagtgatggaaagttaactacgaactcctgcggggaaaagaagagacgatct

SEQ ID NO: 290537 - DNA, 331 bp, Homo sapiens
gtcctaggctgggacccgggctgtccgccagggctgggagacactggaggaggccggccgatgattacgcgcgatgccaacgacgactgccctacggtggaccgcggctgcccgtgtgcggaggaaagggagaggcggctgggtgccggctgcgctgcggtccgtgagccaggacagagtcccaggctgtacagtgatgggcggagagactcgcagtcctgagaaatctgtgccccagtccctggaggacctccgccaactccgcaggacccccggggtagagaggaggggtgttgcggggaattttaaccaataaagagtagagaccggt

SEQ ID NO: 290538 - DNA, 2437 bp, Homo sapiens
gcgctggcaattcaaactgataccgggttggagaggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggatgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaaactaatttccttcccaatattaggacttagaaaagctctaggtcccgcaacttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaatataa

SEQ ID NO: 290539 - DNA, 2412 bp, Homo sapiens
cggacgcgtgggtcgacccacgcgtcggggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggatgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaaactaatttccttcccaatattaggacttagaaaagctctaggtcccgcaacttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaatataa

SEQ ID NO: 290540 - DNA, 2102 bp, Homo sapiens
agcaggaggagaggatgggagaagagcctagaagagggagagaggctccaaaagtttatgcatgtattaaaaacacacacacacacacgacacacacacgagcggccggcaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaaactaatttccttcccaatattaggacttagaaaagctctaggtcccgcaacttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaatataa

SEQ ID NO: 290541 - DNA, 2283 bp, Homo sapiens
cggacgcgtgggtcgacccacgcgtcggggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaaactaatttccttcccaatattaggacttagaaaagctctaggtcccgcaacttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaatataa

SEQ ID NO: 290542 - DNA, 2471 bp, Homo sapiens
gcgctggcaattcaaactgataccgggttggagaggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggatgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaaactaatttccttcccaatattaggacttagaaaagctctaggtcccgcaacttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttggccaaatttttccctttgctttaacaaaacccaaaaggttggcttccaggccctctagcgggcacatgacaggcgctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaatataa

SEQ ID NO: 290543 - DNA, 1807 bp, Homo sapiens
cggacgcgtgggtcgacccacgcgtcggggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaatataa

SEQ ID NO: 290544 - DNA, 1905 bp, Homo sapiens
cggacgcgtgggtcgacccacgcgtcggggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaatataa

SEQ ID NO: 290545 - DNA, 1541 bp, Homo sapiens
cggacgcgtgggtcgacccacgcgtcggggagcgaaaaccaacgtgttcggtgacagaccccagcgccgactgagcctctaaagcgacttcagctctgccccaccaacaccaccgcgcgcccgggaacagccgctccggcgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaatataa

SEQ ID NO: 290546 - DNA, 1773 bp, Homo sapiens
cggacgcgtgggtcgacccacgcgtcggggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagcgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaatataa

SEQ ID NO: 290547 - DNA, 1675 bp, Homo sapiens
cggacgcgtgggtcgacccacgcgtcggggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaagcgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaatataa

SEQ ID NO: 290548 - DNA, 1497 bp, Homo sapiens
cttgagaacagggtcctatgactctttaaccaattatgttcaaaggagtccccaaagtgttaagcagtttcaaggacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaatataa

SEQ ID NO: 290549 - DNA, 1352 bp, Homo sapiens
gcgctggcaattcaaactgataccgggttggagaggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggatgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaaactaatttccttcccaatattaggacttagaaaagctctaggtcccgcaacttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacagacttctgcaagatgccaagaggggaacttgggctttttcttttttccaatttgccttttacagagtgatggaaagttaactacgaactcctgcggggaaaagaagagacgatct

SEQ ID NO: 290550 - DNA, 1627 bp, Homo sapiens
gcgctggcaattcaaactgataccgggttggagaggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggatgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaaactaatttccttcccaatattaggacttagaaaagctctaggtcccgcaacttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaagtaagtcatgctagtggcgggcaacggtagcttttaactaaatgggaacacttatggcttggatctgtgggagtcaacaaggaggttatcatttcggtgtttcagccactcccaccagtttgatgatccccttggaatatatctaagtgggcagactgtctggacaaagtctgtggtttagccaaggtggtcagtcctgatgtaatgcttctagttcaattgcagtcatgcgaccacacatctcttaagtttgatccctggttcagtgccctgcccaaccatcctatttcactgaatcaagtccgtggcgtagactttaggtaaattcaggcaaaattttctgtactgttggagaggagaggtcatttaagtttttcatttttatccatgaaattttgcaccaaaaaaaaaaaatccgttttctatcattatttgcaattggcatcctaaatcagatccgttgttcatcaaattcagttttctttcctcaaaactctctctctctgaaagagatgtaaatagatttttatgggatgaaaaatagagacttagccttaatccttatctccaataaagactattttggacatta

SEQ ID NO: 290551 - DNA, 369 bp, Homo sapiens
ccctggaggacctccgccaactccgcaggaccccgccgggaagtagagcccacccctttaccaatcaccgcccgttttctatcgaccgatggggcccatagccaataggaagagctgatcccgagaggcccggaatgagggggaggagctggcaaaacttggaggtgtgactagcactgccgaggcgtggtcacagattaagctccaccccgggttgttgaacccctaagtagaactgatgggcgggattaaggtggaaccgacgaccaaacacaaactcttgagctgaggcacggccaattgggccggggtagagaggaggggtgttgcggggaattttaaccaataaagagtagagaccggtggaga

SEQ ID NO: 290552 - DNA, 277 bp, Homo sapiens
atggtctatttatataagcaatatgaaaagacttatctggctagttattacatggtatctagtaacatttactttcttttctagtgggaacattgtaggttatcatgtgattgttccatgtagttcctgtcttctttcctgcaacaacggacacttctggatgtttcacagccaggcagtttatgatattaacagactagactccacaggtaagaaacaattgacttggacattcctgtaacatttctctatcaatacctgagtaaaattcccaata

SEQ ID NO: 290553 - DNA, 1386 bp, Homo sapiens
agaggaagagtgatgtggcagctcctggaaacccaggcatctctgggaaagcaagcagtgttatggctcatgtgtcaccttttacccacaggagttgatgatgtggttcccggtatgccaagtaactaggagggaggaggtcagcactggggaggggaaggtaacatcctcagtcaaagttggacctcccagacctgttaggcagagttacaaagaaagacaatgggttggaaggaggatggaaactgaggtgctggccaagaacatagcaagattttggccccccaaaacaagctggaaagtgatgtcacttcctatgtaataataatgtggcttccgtggaaaccttccaacttaacactgcagaatctgaaaagaaatggcaatgagcagaggtctcccaccctcacgtggaggacagggtccgcaaagatgagtcacattgtagaacttcactattcagagaaagacccttcacatgcagaatctcgctggtctctcaggacaatcctgtgaggtaggcagcaccaggggtgttactgccccttacagaagagggaactggcattagtgatgatcagaatgggtcttagatagctctgggatgtgcaggaaggacacttgtatgaagaataaaagaccggccgggcgagtggctcacgcctgtaatcccagcactttgggaggccaagacaggcggatcatgaggtcaggcattcgagaccagcctggccaacatagtgaaaccccatctctactaaaaatacaaaaaattagccgggcgtggttggcgggcgcctgtaatcccagctacttgggaggctgaggcaggagaatcgctttaacccggaaggtggaggttgcagtgagccaagattgtggccactgcactccagcccgggcgacagtgcgagactccatctcaaaaaaaaaaataataaaataaaaataaaagactgcaggccctttctccttccccgtgcccatttctgtagaatcatttattcattaaattcactgaacactttccatgggctgggcactcttaggcattgggaacataggagtacacaggtcctgggcactgtcctccccttgtggctgggtcagtcatccttactctgaatcatgggcccagactggccttgccctactcctctctaggtagagcagtgatctcaggccaactcttgcattttgttccagaaaccttgattatttccctgactattggtcacttcccgaaatgcactgaactgtgccaggaataggatatgtttttaagtgcttgagacacagacaagtggcagacgcatacccaaattccaaccatactttacttctgacctaattttaatatatgtttcatgcagttacacaattatc

SEQ ID NO: 290554 - DNA, 3244 bp, Homo sapiens
  misc_feature (859)..(859): n is a, c, g, or t
cagcctccctctcccacctctgtctgcccgctgcctcttgtctagctgctgtcaggagctgactgcctccagggctggaatcctgtgctccctctgtgcccagagccccacgatgtcggccaacgccacactgaagccactctgccccatcctggagcagatgagccgtctccagagccacagcaacaccagcatccgctacatcgaccacgcggccgtgctgctgcacgggctggcctcgctgctgggcctggtggagaatggagtcatcctcttcgtggtgggctgccgcatgcgccagaccgtggtcaccacctgggtgctgcacctggcgctgtccgacctgttggcctctgcttccctgcccttcttcacctacttcttggccgtgggccactcgtgggagctgggcaccaccttctgcaaactgcactcctccatcttctttctcaacatgttcgccagcggcttcctgctcagcgccatcagcctggaccgctgcctgcaggtggtgcggccggtgtgggcgcagaaccaccgcaccgtggccgcggcgcacaaagtctgcctggtgctttgggcactagcggtgctcaacacggtgccctatttcgtgttccgggacaccatctcgcggctggacgggcgcattatgtgctactacaatgtgctgctcctgaacccggggcctgaccgcgatgccacgtgcaactcgcgccaggcggccctggccgtcagcaagttcctgctggccttcctggtgccgctggcgatcatcgcctcgagccacgcggccgtgagcctgcggttgcagcaccgcggccgccggcggccaggccgcttcgtgcgcctggtggcngccgtcgtggccgccttcgcgctctgctgggggccctaccacgtgttcagcctgctggaggcgcgggcgcacgcaaacccggggctgcggccgctcgtgtggcgcgggctgcccttcgtcaccagcctggccttcttcaacagcgtggccaacccggtgctctacgtgctcacctgccccgacatgctgcgcaagctgcggcgctcgctgcgcacggtgctggagagcgtgctggtggacgacagcgagctgggtggcgcgggaagcagccgccgccgccgcacctcctccaccgcccgctcggcctcccctttagctctctgcagccgcccggaggaaccgcggggccccgcgcgtctcctcggctggctgctgggcagctgcgcagcgtccccgcagacgggccccctgaaccgggcgctgagcagcacctcgagttagaacccggcccacgtagggcggcactcacacgcgaaagtatcaccagggtgccgcggttcaattcgatatccggactcctgccgcagtgatcaaagtccgaggggcgggacccaggcacctgcattttaaagcgccccgggagactctgaatctttttcagaaacagtgagttaaagcagtgcttctcaaaccttgatgtgcctgtgaatcacctaggggtcttgttaagtgcagtctgatccaggaggccggggccgggtactgagagtctgcacttaacaagctcccaggccgagaagccagtgcggcaggttcacaggcgaggcctggagtaacacaaagtgaaactcataatagacttcccactctagggcagtggagtcggaagggcacacggggtgcgtctccccggagttcagttttaccagatgatgggggaggggggaaggagttttatgttaaaccatccatgtatttttggagaagagagaggaaaggtttgagaagcactgttccagcctgccctcttcatttagccaatgcttactgcgctagacgcttcatcccacaatcttaaggggcagcttctattagccagtctttacagctgagcacattctggctcagggaggttaagtgacttgcccagtttcagggctaacgaccacagggtctgcactctaaccctaggcatcacatgctcaatgactctctggtgagcgaggacattctctgacctactcgagggacttaagatgctaccttgtgacccagcactgcccaaagtgcttccaaggcagaagcagcaggggatggcgtggtcaagcactcgggaaacctggggctaatcaaatccaatgggggaaatgactaaaagtcttcggtcgttagaagttgaatgggcacagcaactctaagactacagcacacgtcatttcttagctaagcggaccagcctccctgtcggcctggtgttctgtgggatccctctgggcactggtaatcccaagatctgtgcagccccgcctccaggccacatggggctgggcagctaccatttcccttttgcggatgggaggggtaacttgcacctctgacctatcacttccactgcaccccgtctcattcctccacctgccgtggacttggggtcagagactgctgtgtttgagctctgcagcccagggaccgaaaagttggtgtcaatgaattttgcttggtggatgaaatgtcagtggaagaagcagatgagaaactcttgagatcttggtcctgtgttttttctgccaccaaaggccagggtcactgaaggcctggcccacagcaggtgctgagcaaagggaacagtgaggtgcccagctagctgcagagccaccctgtgttgacacctcgcccctgctccctcccatcccttccccctttactcatagcacttcccccattggacacgtggtgcattttgcttgtttattatgttttctctccatcagaatgaaagctcctcgagggcagggactttggtctattgtctgtatttgccggtgcctaggattgtgcctgtatgcaacaggcactcaataaatatttttgctgtagactggacaggcatgagttagattctctggggcttctgcagagactggtttgggaaagtgggtgctagggaaaagctctgctccctgcaacctccccattttaatctttcagtattgaaaagtggagaggaaccggattcagtttgctggggacagaggcagtggggtgtggagaggcgggaccggggttggggagagtggggctcagcatgcgcgtgcgcaattcgcgcgagcgcagtcaacatgtgattgatgagccagtctttttcctgggattcgcttttgcctttcttgcaaagtttcctggggaaagaagagcgagcaagtagaaaagggaaagtgggaggac

SEQ ID NO: 290555 - DNA, 1170 bp, Homo sapiens
agcgggcgagacgaccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttgagaaagctatattttccaatagtaccccttgtgtaaagttacgaaaaaaacaagcccttcagtactggttagcaggaagaaatgtcctacaaaagacgagtctgtcaacctagtgcctgtgttctgtacagggcttatttatttactgttaataaacagatcttcc

SEQ ID NO: 290556 - DNA, 1527 bp, Homo sapiens
agcgggcgagacgaccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagacagagtctcactttgtcacctaggctggagtgcagtgacaatcaccactcattgcagcctccacctcccgggctcaagaaatcctcctgcctcagcctcctgagaacttgggactacagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttgagaaagctatattttccaatagtaccccttgtgtaaagttacgaaaaaaacaagcccttcagtactggttagcaggaagaaatgtcctacaaaagacgagtctgtcaacctagtgcctgtgttctgtacagggcttatttatttactgttaataaacagatcttccaaaacacacagttacctggttcacagatagctgctttttattgacaaacaagatcatagtatttcagtcatggtgtcaagcacattaatacttttctgttactcagcatttttttttatatcagttcaaaagctacttttgccaagaaggatgagacaaaaggccagacagaaattggactttggttttcagacatgggactctcatgttaacaaagaataaataagcaaatatt

SEQ ID NO: 290557 - DNA, 659 bp, Homo sapiens
agcgggcgagacgaccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatggtaagtatttaaaaggtaagtattacaggcctctctggaggaggtagccagcccatgggatgttcccagatttaaactaaaaccataaaagtgagacttatatttaaaaggtaaatctctttatttttaaagagatgcagcaggttttcatggatagggaattagcatttcaactttatcttcaagacggcaagcgg

SEQ ID NO: 290558 - DNA, 752 bp, Homo sapiens
atgagtttcacttagactttgctatttgatttattttcttacagcagaaggtgatttactacctctgcatcttattgaaagatccagtggaaccacatgggatatcccaagtagtacccgtcttccagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttgagaaagctatattttccaatagtaccccttgtgtaaagttacgaaaaaaacaagcccttcagtactggttagcaggaagaaatgtcctacaaaagacgagtctgtcaacctagtgcctgtgttctgtacagggcttatttatttactgttaataaacagatcttcc

SEQ ID NO: 290559 - DNA, 1321 bp, Homo sapiens
agcgggcgagacgaccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttgagaaagctatattttccaatagtaccccttgtgtaaagttacgaaaaaaacaagcccttcagtactggttagcaggaagaaatgtcctacaaaagacgagtctgtcaacctagtgcctgtgttctgtacagggcttatttatttactgttaataaacagatcttccaaaacacacagttacctggttcacagatagctgctttttattgacaaacaagatcatagtatttcagtcatggtgtcaagcacattaatacttttctgttactcagcatttttttttatatcagttcaaaagctacttttgccaagaaggatgagacaaaaggccagacagaaattggactttggttttcagacatgggactctcatgttaacaaagaataaataagcaaatatt

SEQ ID NO: 290560 - DNA, 333 bp, Homo sapiens
tactactccccgtcctgccgggaattctgcctcagctgccctcggctctcgctgcgttcgctcaccgctgtcacctgcacggtgtggctggcggcctacggactcttcaccctctgcgaggtaatggcaagtcggcccctccccgcgctcgaaggagggggttcggctttgggagggtctttggggtctttggtcgagcccggacctctggtcggcccctcctacagtgataggacaggagggcgggaactcacgggttctggggacgatattccgctgctggacagctctttaaatgacgtttagtgaaatgtgtgctcctggatagtacat

SEQ ID NO: 290561 - DNA, 1405 bp, Homo sapiens
agcgggcgagacgaccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttgagaaagctatattttccaatagtaccccttgtgtaaagttacgaaaaaaacaagcccttcagtactggttagcaggaagaaatgtcctacaaaagacgagtctgtcaacctagtgcctgtgttctgtacagggcttatttatttactgttaataaacagatcttccaaaacacacagttacctggttcacagatagctgctttttattgacaaacaagatcatagtatttcagtcatggtgtcaagcacattaatacttttctgttactcagcatttttttttatatcagttcaaaagctacttttgccaagaaggatgagacaaaaggccagacagaaattggactttggttttcagacatgggactctcatgttaacaaagaataaataagcaaatatt

SEQ ID NO: 290562 - DNA, 867 bp, Homo sapiens
agcgggcgagacgaccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccaggctgcatggtgcattcattctaagctggcaacccgaccctcctgcttcctgaacagaaccttacctgggccatcagggcagccatctcaagagccaattccttgttgataggaaacctccctgccactatctctctactggtttgagaggcaaggagcagccgttctcggtccgtctcccctttgacttgactgcgaaagtacagcctacaaagaagagaataagaaaccaggactcagcagggattccaaacagggatggggctttctctgggtctgttacctttatttccaaaaagataaagtactcttttcccactat

SEQ ID NO: 290563 - DNA, 1476 bp, Homo sapiens
tgcggccgccgcagatatccgaaaagctttgctcatcctccatgacgcccccactcggccgcccgcaccgcgcggcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagacagagtctcactttgtcacctaggctggagtgcagtgacaatcaccactcattgcagcctccacctcccgggctcaagaaatcctcctgcctcagcctcctgagaacttgggactacagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttgagaaagctatattttccaatagtaccccttgtgtaaagttacgaaaaaaacaagcccttcagtactggttagcaggaagaaatgtcctacaaaagacgagtctgtcaacctagtgcctgtgttctgtacagggcttatttatttactgttaataaacagatcttccaaaacacacagttacctggttcacagatagctgctttttattgacaaacaagatcatagtatttcagtcatggtgtcaagcacattaatacttttctgttactcagcatttttttttatatcagttcaaaagctacttttgccaagaaggatgagacaaaaggccagacagaaattggactttggttttcagacatgggactctcatgttaacaaagaataaataagcaaatatt

SEQ ID NO: 290564 - DNA, 824 bp, Homo sapiens
tgttagattaaaaccgttaaacagtgtacggcgaatcggagagatctcttatctcagcagaagcctacttctgaatggcagtcagatatgcatcaatgaggcttacatgccagaaccagaaggtgatttactacctctgcatcttattgaaagatccagtggaaccacatgggatatcccaagtagtacccgtcttccagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttgagaaagctatattttccaatagtaccccttgtgtaaagttacgaaaaaaacaagcccttcagtactggttagcaggaagaaatgtcctacaaaagacgagtctgtcaacctagtgcctgtgttctgtacagggcttatttatttactgttaataaacagatcttcc

SEQ ID NO: 290565 - DNA, 4515 bp, Homo sapiens
  misc_feature (449)..(450): n is a, c, g, or t
  misc_feature (1273)..(1274): n is a, c, g, or t
  misc_feature (1294)..(1295): n is a, c, g, or t
gtgcccctgacaggcttttaaaaggcccggatgccaatgcacattccaacactatccacaaaaaggagactgagcagtgctcttccctgcattgggcaaggagactctccctccctgcctaaccacttgcctgccctgttttgtgggagaattacaagtaaatgctacagaggcagtggagaaaaaagggtgttttaattcctctccagagtttcctttatttgatgtatgttgcatcctttaaacaagttgtgcaaaatggctgcagggtagattggctctcccttttaaagctctccatccggctgggtttatttgtaaatactgcatctatccttcttagtgttttaggactggctggaaagactcttcttcctgtaggttgggtcagtgtgagagatctaaaaaatcattttcccttaaaattactgtattttaataaaaggatnnggcaggggctggaatgagagaaaactggtccttcaaaatgtaaaactgtcatacttaaaccagtttacaaaatatgcgtttaattatgtggtgggatgtgtgtaggtgtatgatgagagaggcaaccaacatggctatttggggtgcaaggatgtgggaacaggcaagtaattttcacattggactttcatcctagggagctgggttctagtcacagctctgagctgtgtgaccttgggtaggtctcatctccccggggttttgtttcaccagttgaacagtatgaggatgagtcacagctaacatttgttccatgatatttacccagcaccatacaagtgttatttctgtcctcccagttaacactgacgtgggtagtattatatgcccattttacagatgaggaaactgaagcctgaagaagttaaatacttatcccagaacacacagctggtaagtggcagacctggaattggaatctagttcagtttgattccccaacccatgctcttgaccactatactgttttttcaagtccagatctgaaatctcattttctgtgtggctgtgtgtttgggacaggggtaaccaattcctgactactctatatgctgcatagaacctggagaggatttttcaaagtaaatgaatctcgaaagctggattgcagagcaaacgagtgcagtcaattcagccaggggcttgcaagagggagaaagagaaaaagactgtggaatggaaagtttcccaacccaagcctttcccaaggggtagccattctctgttctacagtttagggcttgcatgtgctttttctggagtnnaaaaatacataagttataannaatttaacagacagaaaggcgcacagaggaatttaaagtgtgggctggggggcgaggcggtgggcgggaggcgagcgggcgcaggcggaacaccgttttccaagctaagccgccgcaaataaaaaggcgtaaagggagagaagttggtgctcaacgtgagccaggagcagcgtcccggctcctcccctgctcattttaaaagcacttcttcttgtattgtttttaaggtgagaaataggaaagaaaacgccggcttgtgcgctcgctgcctgcctctctggctgtctgcttttgcagggctgctgggagtttttaagctctgtgagaatcctgggagttggtgatgtcagactagttgggtcatttgaaggttagcagcccgggtagggttcaccgaaagttcactcgcatatattaggcaattcaatctttcattctgtgtgacagaagtagtaggaagtgagctgttcagaggcaggagggtctattctttgccaaaggggggaccagaattcccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatgcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagattgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcctggcaaagaataaaatatatttattttaaaaaaat

SEQ ID NO: 290566 - DNA, 4872 bp, Homo sapiens
  misc_feature (449)..(450): n is a, c, g, or t
  misc_feature (1273)..(1274): n is a, c, g, or t
  misc_feature (1294)..(1295): n is a, c, g, or t
gtgcccctgacaggcttttaaaaggcccggatgccaatgcacattccaacactatccacaaaaaggagactgagcagtgctcttccctgcattgggcaaggagactctccctccctgcctaaccacttgcctgccctgttttgtgggagaattacaagtaaatgctacagaggcagtggagaaaaaagggtgttttaattcctctccagagtttcctttatttgatgtatgttgcatcctttaaacaagttgtgcaaaatggctgcagggtagattggctctcccttttaaagctctccatccggctgggtttatttgtaaatactgcatctatccttcttagtgttttaggactggctggaaagactcttcttcctgtaggttgggtcagtgtgagagatctaaaaaatcattttcccttaaaattactgtattttaataaaaggatnnggcaggggctggaatgagagaaaactggtccttcaaaatgtaaaactgtcatacttaaaccagtttacaaaatatgcgtttaattatgtggtgggatgtgtgtaggtgtatgatgagagaggcaaccaacatggctatttggggtgcaaggatgtgggaacaggcaagtaattttcacattggactttcatcctagggagctgggttctagtcacagctctgagctgtgtgaccttgggtaggtctcatctccccggggttttgtttcaccagttgaacagtatgaggatgagtcacagctaacatttgttccatgatatttacccagcaccatacaagtgttatttctgtcctcccagttaacactgacgtgggtagtattatatgcccattttacagatgaggaaactgaagcctgaagaagttaaatacttatcccagaacacacagctggtaagtggcagacctggaattggaatctagttcagtttgattccccaacccatgctcttgaccactatactgttttttcaagtccagatctgaaatctcattttctgtgtggctgtgtgtttgggacaggggtaaccaattcctgactactctatatgctgcatagaacctggagaggatttttcaaagtaaatgaatctcgaaagctggattgcagagcaaacgagtgcagtcaattcagccaggggcttgcaagagggagaaagagaaaaagactgtggaatggaaagtttcccaacccaagcctttcccaaggggtagccattctctgttctacagtttagggcttgcatgtgctttttctggagtnnaaaaatacataagttataannaatttaacagacagaaaggcgcacagaggaatttaaagtgtgggctggggggcgaggcggtgggcgggaggcgagcgggcgcaggcggaacaccgttttccaagctaagccgccgcaaataaaaaggcgtaaagggagagaagttggtgctcaacgtgagccaggagcagcgtcccggctcctcccctgctcattttaaaagcacttcttcttgtattgtttttaaggtgagaaataggaaagaaaacgccggcttgtgcgctcgctgcctgcctctctggctgtctgcttttgcagggctgctgggagtttttaagctctgtgagaatcctgggagttggtgatgtcagactagttgggtcatttgaaggttagcagcccgggtagggttcaccgaaagttcactcgcatatattaggcaattcaatctttcattctgtgtgacagaagtagtaggaagtgagctgttcagaggcaggagggtctattctttgccaaaggggggaccagaattcccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatggtaaatgatcatttggatcaattacaggcttttagctggcttgtctgtcataattcatgattcggggctgggaaaaagaccaacagcctacgtgccaaaaaaggggcagagtttgatggagttgggtggacttttctatgccatttgcctccacacctagaggataagcacttttgcagacattcagtgcaagggagatcatgtttgactgtatggatgttctgtcagtgagtcctgggcaaatcctggatttctacactgcgagtccgtcttcctgcatgctccaggagaaagctctcaaagcatgcttcagtggattgacccaaaccgaatggcagcatcggcacactgctcaatcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagattgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcctggcaaagaataaaatatatttattttaaaaaaat

SEQ ID NO: 290567 - DNA, 321 bp, Homo sapiens
catagagctgtgaaaacctctttatttgttgtagatttttaacactaatataaattttctttttggattttctagagagaacaaggataaagaagtatccaaatacaaagaaaatgttatgcaagtgacctttagagatgttttaaagatgacaaaatattgatgaagatgggccaacaagtgttactgttacctctaataaagtttcatcactagtttcaccatggttaattggaaatggcttccgcccatctgtggaaaacagacaaacaattgaatgcttagctgtttttacaggataatgtgctttcaacttccatt

SEQ ID NO: 290568 - DNA, 549 bp, Homo sapiens
gcggccgcccggcccgcttgacataccagaaatagctgcacacaattgtacctttcccggccaagaaacctcccccgctggggagcgcggcccgccgccctcacctgagccccggccagctgagcccgctacccgctctcccgccgcgatccggcccagccgccagctaaagaagtcactttcaagagatctggagaagtaagatggccaaataaaagcctctaccaatcatcctccccacaggaacaccaaatttaagaactatctacacaaaaaagcaccttcataagaaccaaaaatcagagagaacaaggataaagaagtatccaaatacaaagaaaatgttatgcaagtgacctttagagatgttttaaagatgacaaaatattgatgaagatgggccaacaagtgttactgttacctctaataaagtttcatcactagtttcaccatggttaattggaaatggcttccgcccatctgtggaaaacagacaaacaattgaatgcttagctgtttttacaggataatgtgctttcaacttccatt

SEQ ID NO: 290569 - DNA, 593 bp, Homo sapiens
gcggccgcccggcccgcttgacataccagaaatagctgcacacaattgtacctttcccggccaagaaacctcccccgctggggagcgcggcccgccgccctcacctgagccccggccagctgagcccgctacccgctctcccgccgcgatccggcccagccgccaggcatattctaccagtgcaagagatcaacaatgattacaaaattgctaaagaagtcactttcaagagatctggagaagtaagatggccaaataaaagcctctaccaatcatcctccccacaggaacaccaaatttaagaactatctacacaaaaaagcaccttcataagaaccaaaaatcagagagaacaaggataaagaagtatccaaatacaaagaaaatgttatgcaagtgacctttagagatgttttaaagatgacaaaatattgatgaagatgggccaacaagtgttactgttacctctaataaagtttcatcactagtttcaccatggttaattggaaatggcttccgcccatctgtggaaaacagacaaacaattgaatgcttagctgtttttacaggataatgtgctttcaacttccatt

SEQ ID NO: 290570 - DNA, 412 bp, Homo sapiens
gcggccgcccggcccgcttgacataccagaaatagctgcacacaattgtacctttcccggccaagaaacctcccccgctggggagcgcggcccgccgccctcacctgagccccggccagctgagcccgctacccgctctcccgccgcgatccggcccagccgccagagagaacaaggataaagaagtatccaaatacaaagaaaatgttatgcaagtgacctttagagatgttttaaagatgacaaaatattgatgaagatgggccaacaagtgttactgttacctctaataaagtttcatcactagtttcaccatggttaattggaaatggcttccgcccatctgtggaaaacagacaaacaattgaatgcttagctgtttttacaggataatgtgctttcaacttccatt

SEQ ID NO: 290571 - DNA, 940 bp, Homo sapiens
gcggccgcccggcccgcttgacataccagaaatagctgcacacaattgtacctttcccggccaagaaacctcccccgctggggagcgcggcccgccgccctcactgagcccgctacccgctctcccgccgcgatccggcccagccgccaggtgagcgccgtcccctcccacgctccccgccccctgcggcggccgggccctcccggcggcagaggagggtcgtggccttggcacgtgctgccgcttccccccggcggagttcggccccgctccgcccggcttccaggtgggtgcggtggaaggagggtccctgcccctccaccccggctcgcggctgagggttcgagcaagctggagggttccttgcattccccacttcccgcccgctcagcccagtttaggccgtttgatgatcgccctcgcggtgagcgtcaaaattcccacccttcgtggtttgaggacactcaggggacagcgaggtggcaggttatgcggtatccgccgcggccctgggcatattctaccagtgcaagagatcaacaatgattacaaaattgctaaagaagtcactttcaagagatctggagaagtaagatggccaaataaaagcctctaccaatcatcctccccacaggaacaccaaatttaagaactatctacacaaaaaagcaccttcataagaaccaaaaatcagagagaacaaggataaagaagtatccaaatacaaagaaaatgttatgcaagtgacctttagagatgttttaaagatgacaaaatattgatgaagatgggccaacaagtgttactgttacctctaataaagtttcatcactagtttcaccatggttaattggaaatggcttccgcccatctgtggaaaacagacaaacaattgaatgcttagctgtttttacaggataatgtgctttcaacttccatt

SEQ ID NO: 290572 - DNA, 1515 bp, Homo sapiens
agcgggagggtgcccggttcatccaaggcgcaagatggcgctgctttttgcacgttctttgcgcttgtgccgctggggagccaaacgattgggagttgcctccacagaggcccagagaggcgtcagtttcaaactggaagaaaaaaccgcccacagcagcctggcactcttcagagatgatacgggtgtcaaatatggcttggtgggattggagcccaccaaggtggccttgaatgtggagcgcttccgggagtgggcagtggtgctggcagacacagcggtcaccagtggcagacactactgggaagtgacagtgaagcgctcccagcagttccggataggagtggcagatgtggacatgtcccgggatagctgcattggtgttgatgatcgttcctgggtgttcacctatgcccagcgcaagtggtacaccatgttggccaacgagaaagccccagttgagggtattgggcagccagagaaggtggggctgttgctggagtatgaggcccagaagctgagcctggtggatgtgagccaggtctctgtggttcacacgctacagacagatttccggggtccagtggtgcctgcctttgctctctgggatggggagctgctgacccattcagggcttgaggtgcccgagggcctctagtatgtccattactggagtccctaatcacgcctttggccagcctccttttgaaagtgtccgaagcctttttactttgcctcaagcaacctctagctcccacaattcagtgttgggtcctctgtgcaatatcatgatcatcttcctcatcccctaccttgtgaaagctaggcatacagccaaaccctccttttccccacccaccaacactactgccaatttcctaggctaccatgggtgtatcttccttgacctgcttccttcagtccctctgcctccctttgcccaggcctttctcagactgtattccatcctggggtcttatcattcagctttgtttgaatttattaatcaccatgatacctctccctccctttgtccacatgtaacttgttcttggggctctaccagatggctgaagagtaaatcctttctacctctggctgaaggagtggtgcagtcaatgacttggccctttttctacagcacatttagagtttgggctctggctccctcagtaagtgctttattaactcagtgtgtcaaaatgaaaacagagccctccttccccagtagctcagtgccacagaccttcagccccacacagctgtagctatccttaccctgagtccatctaccttaaatctgtacctctgacacccagccagtctgtcataatcattatcccagttataaccttgaccaaaggggaagagagacacttgggggatatctaggggatgagtgctagaaactatttatttatttttgagacagagtctcactctgtcacccaggctggagtgcagtggcatgatcttggctcactgcaaactctgccttttgggttcaagcgactc

SEQ ID NO: 290573 - DNA, 1102 bp, Homo sapiens
agcgggagggtgcccggttcatccaaggcgcaagatggcgctgctttttgcacgttctttgcgcttgtgccgctggggagccaaacgattgggagttgcctccacagaggcccagagaggcgtcagtttcaaactggaagaaaaaaccgcccacagcagcctggcactcttcagagatgatacgggtgtcaaatatggcttggtgggattggagcccaccaaggtggccttgaatgtggagcgcttccgggagtgggcagtggtgctggcagacacagcggtcaccagtggcagacactactgggaagtgacagtgaagcgctcccagcagttccggataggagtggcagatgtggacatgtcccgggatagctgcattggtgttgatgatcgttcctgggtgttcacctatgcccagcgcaagtggtacaccatgttggccaacgagaaagccccagttgagggtattgggcagccagagaaggtggggctgttgctggagtatgaggcccagaagctgagcctggtggatgtgagccaggtctctgtggttcacacgctacagacagatttccggggtccagtggtgcctgcctttgctctctgggatggggagctgctgacccattcagggcttgaggtgcccgagggcctctagtatgtccattactggagtccctaatcacgcctttggccagcctccttttgaaagtgtccgaagcctttttactttgcctcaagcaacctctagctcccacaattcagtgttgggtcctctgtgcaatatcatgatcatcttcctcatcccctaccttgtgaaagctaggcatacagccaaaccctccttttccccacccaccaacactactgccaatttcctaggctaccatgggtgtatcttccttgacctgcttccttcagtccctctgcctccctttgcccaggcctttctcagactgtattccatcctggggtcttatcattcagctttgtttgaatttattaatcaccatgatacctctccctccctttgtccacatgtaacttgttcttggggctctaccagatggctgaagagtaaatcctttctacctctggctga

SEQ ID NO: 290574 - DNA, 1051 bp, Homo sapiens
agcgggagggtgcccggttcatccaaggcgcaagatggcgctgctttttgcacgttctttgcgcttgtgccgctggggagccaaacgattgggagttgcctccacagaggcccagagaggcgtcagtttcaaactggaagaaaaaaccgcccacagcagcctggcactcttcagagatgatacgggtgtcaaatatggcttggtgggattggagcccaccaaggtggccttgaatgtggagcgcttccgggagtgggcagtggtgctggcagacacagcggtcaccagtggcagacactactgggaagtgacagtgaagcgctcccagcagttccggataggagtggcagatgtggacatgtcccgggatagctgcattggtgttgatgatcgttcctgggtgttcacctatgcccagcgcaagtggtacaccatgttggccaacgagaaagccccagttgagggtattgggcagccagagaaggtggggctgttgctggagtatgaggcccagaagctgagcctggtggatgtgagccaggtctctgtggttcacacgctacagacagatttccggggtccagtggtgcctgcctttgctctctgggatggggagctgctgacccattcagggcttgaggtgcccgagggcctctagtatgtccattactggagtccctaatcacgcctttggccagcctccttttgaaagtgtccgaagcctttttactttgcctcaagcaacctctagctcccacaattcagtgttgggtcctctgtgcaatatcatgatcatcttcctcatcccctaccttgtgaaagctaggcatacagccaaaccctccttttccccacccaccaacactactgccaatttcctaggctaccatgggtgtatcttccttgacctgcttccttcagtccctctgcctccctttgcccaggcctttctcagactgtattccatcctggggtcttatcattcagctttgtttgaatttattaatcaccatgatacctctcccgtacaggggaaactctagatcacctc

SEQ ID NO: 290575 - DNA, 1126 bp, Homo sapiens
agcgggagggtgcccggttcatccaaggcgcaagatggcgctgctttttgcacgttctttgcgcttgtgccgctggggagccaaacgattgggagttgcctccacagaggcccagagaggcgtcagtttcaaactggaagaaaaaaccgcccacagcagcctggcactcttcagagatgatacgggtgtcaaatatggcttggtgggattggagcccaccaaggtggccttgaatgtggagcgcttccgggagtgggcagtggtgctggcagacacagcggtcaccagtggcagacactactgggaagtgacagtgaagcgctcccagcagttccggataggagtggcagatgtggacatgtcccgggatagctgcattggtgttgatgatcgttcctgggtgttcacctatgcccagcgcaagtggtacaccatgttggccaacgagaaacctccttttccccacccaccaacactactgccaatttcctaggctaccatgggtgtatcttccttgacctgcttccttcagtccctctgcctccctttgcccaggcctttctcagactgtattccatcctggggtcttatcattcagctttgtttgaatttattaatcaccatgatacctctccctccctttgtccacatgtaacttgttcttggggctctaccagatggctgaagagtaaatcctttctacctctggctgaaggagtggtgcagtcaatgacttggccctttttctacagcacatttagagtttgggctctggctccctcagtaagtgctttattaactcagtgtgtcaaaatgaaaacagagccctccttccccagtagctcagtgccacagaccttcagccccacacagctgtagctatccttaccctgagtccatctaccttaaatctgtacctctgacacccagccagtctgtcataatcattatcccagttataaccttgaccaaaggggaagagagacacttgggggatatctaggggatgagtgctagaaactatttatttatttttgagacagagtctcactctgtcacccaggctggagtgcagtggcatgatcttggctcactgcaaactctgccttttgggttcaagcgactc

SEQ ID NO: 290576 - DNA, 698 bp, Homo sapiens
tgcagcagatggaagcgagctgatttatatactatagcactgttttaaatcgggtctatgtgccccatcgctcaatgacctggagcgggactccctgaaaggtcacgggccaaatgaaaaagacggaagggctgttgttcgttccccctttaaacacagtactgtaattctccttcagctctccgagttctacaaacatttagaggcttccctctgtgcagccggccgggactggcctccgcacacctcaccctgcagcgcgtcccagggacagagcctagtgagggcgcaggagaaaagggcctgcagaaggcagggagcaggcgtttctattgcactctctcaaaccgagccggaacactttatttcatacatctccggtttctctgtttttccagacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcatt

SEQ ID NO: 290577 - DNA, 271 bp, Homo sapiens
ccaaaattgatctggagcctccatgtcagaccgatgtttaaggtcagtgtggaattacaaatcttcaaattgggaaacagctatcaaagagagaaacataacggcggtagagaggaagtcaccaaggttgccactcagaagcaccgacagtcaccgctcaactggacctccagtcatttcggagaggtgattcccatcaccgacaggcagggacagagtaaatgctcccatactcccggaaaataaggagagagatgagtccgtgcggccg

SEQ ID NO: 290578 - DNA, 988 bp, Homo sapiens
gcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccctactcccgggctttcggagagggtgcgtccgcgcggccgcgctgctgcaggaacggcggtacctgcgtgctgggcagcttctgcgtgtgcccggcccacttcaccggccgctactgcgagcatgaccagaggcgcagtgaatgcggcgccctggagcacggagcctggaccctccgcgcctgccacctctgcaggtgcatcttcggggccctgcactgcctccccctccagacgcctgaccgctgtgacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcatt

SEQ ID NO: 290579 - DNA, 1825 bp, Homo sapiens
  misc_feature (1817)..(1817): n is a, c, g, or t
  misc_feature (1820)..(1825): n is a, c, g, or t
tgatctgaaaggaatggaagcacaaaatgatgaataaggtatttttaacaaagatacatgggtaaattaacagcagtaatgtaaaaaagactgagggagcaacaatgtggaaagggaaggaaaggaagctgtataggaacaatcacacaaataatcatcaaaattaaactttataaatctaaacatagtatctacaacctttatgaaggttaagttttgttaaattgtctaagttttgcatttttacaattttcactgtagagaaaaaaatattaatagttaccaaaggaataaaagactaaaataatttgttatacatctgcaaatagctccttaaatttggaacactaatttcataatgatatttggatccataaatgtgaaactgtcacactgaatgtaggtactgttttccccacaatggatactactgcattggcatctagcagaaattgtaagctatttggaatgttactaaacctactgggactaaggttttcaatcttttgtctttcaaattaaaattaaaaactaattcactctgggcaattcaggtactctaaggaaattcaagtactctagttttaaatacgaattttcaaaaacgcaacccaagtaccctttcctctcaacttctgtgaggccaagccacgacctccacctattcaatctttgctgctagataacaacccttttggtagtgctaggcaacaggcatgatgtgacaaacctagacatcaaaacttttccacagaaagataaggtaaacaagatatacttagcgccacacccatttaaatgcacaagcaaccaaaattgctccctccccccgcaacaccccccccccccccccaaagctccagctggtcaggaaacattgtctttacaatcaagataaacatctggctcagggtgttcagccattcctcacctacaggcttgcctaagccccattctccaatgccatcaccaccagaaccggaacattctgttgggaagccggcaaacgtccaaataccccaagtatcctcgcccgagttctgcaaccaaaaatctgttttggctactgagcatgctcagacttaagacgggcgcgccacatgggagttttcaaagcttaggctccaaactccacgtagtaacagcagctgaaaggaggagaggggaaaaggggaggggaagagactggaatattaatttgagccctgatattgaagtataggacccggccagcggctgaatatggtgaaggcaaaaagacgctgctttggcattctctttgcagcacagagaagtttacatgaagtagaagaaatccttgcagtggtgaaaactgacatggcaagtggcagaaaccaggtctaactaccagctgattgcagtagccggtcacaactgcccagagtgtaattcccaccgataagcgcggatccttatctttgaaacacaaagcgacggcggcacggattcatcaagccattggacagcttcgcagtgcagcagcccaggctgcccggccgagcaccgcagtcctatcaaggtttgctgtagctcagaaggctctgcctacatgactactgcataccctactgggagaattggaagaatgtgatgatggtaggagtcacccagcatagaagcatgagtgaatgacatcccagagatctgcaaaggatcctggtagccacttcaaagactttttctcccttcctcagacaatcatggcacatggacatcagaggaagaaatggcgaagtttgtatgactcctccagcagagtccttggaaacaataaagcttcctttccaaattctganaannnnnn

SEQ ID NO: 290580 - DNA, 966 bp, Homo sapiens
tcagaacagcaatagactttcaagaggaggaactcacatttctgcaaaagaaagaggccgtaaatgaaaagcagcttggagagaatgagcccacatgcatgagacacagcacacgactcacacccttcttcctcaagtttctctaacatgtgtggctcttggaaacagacatgtcatggctgagttattttttgtgcaaacaaggacacatctgcctctccaggacctcagattcctgacaacactgttggcttcccggagactccttcatcctgcagaagatgcaattccacggggtcctgagagattggacatgggtgggatgtggcagtcctcatggaagactcttgaacaagtgtcgcaacagaacagctcccctccgtcccggcacacctcacactcatccaagtttctcatctagaagacatctggctgtgggctgtgagacataaacctccatgtcaagctcatacaaaatcagccacgcaaacactgacctccagggctgttttaaccattcgtgagtccctgagttggccgggcatcaaaatcagtgtggaaaagacctaaatctgattggaggactgctttggaggttctcattcacacccagtcttcgaaaaaccatcaccttgtcctgaatctacactgcacttaacctatttgtttgttgcgttcttaagtgaaggaaaaatcactttcacagataaaaagcaggtctgcacagtccctctggtagaaccaaagaggtggcatcaacataaaagattttcctggtcagctcctcctgtaaaatacgtttgcctctggagatcttcctccccaatggcaccatcttgacaaaggtaaataatttcccattgagaaagaattctgtgtatctgtgtgtacatttttttggaaggtgaaagaggatgtgaaagatcagaaaagaaatattatttttattacctatttcatgaaatg

SEQ ID NO: 290581 - DNA, 1119 bp, Homo sapiens
tcagaacagcaatagactttcaagaggaggaactcacatttctgcaaaagaaagaggccgtaaatgaaaagcagcttggagagaatgagcccacatgcatgagacacagcacacgactcacacccttcttcctcaagtttctctaacatgtgtggctcttggaaacagacatgtcatggctgagttattttttgtgcaaacaaggtgtggtgttctatcagtgccattgaagtgtggcgcggaagagcaggctcctttcagtacattcccctgcccttgcgcttgttcatggttctcacgtgtgaggggaaaggagaaggcttggggtttgcatctgatttaccaactgttcctcaggacacatctgcctctccaggacctcagattcctgacaacactgttggcttcccggagactccttcatcctgcagaagatgcaattccacggggtcctgagagattggacatgggtgggatgtggcagtcctcatggaagactcttgaacaagtgtcgcaacagaacagctcccctccgtcccggcacacctcacactcatccaagtttctcatctagaagacatctggctgtgggctgtgagacataaacctccatgtcaagctcatacaaaatcagccacgcaaacactgacctccagggctgttttaaccattcgtgagtccctgagttggccgggcatcaaaatcagtgtggaaaagacctaaatctgattggaggactgctttggaggttctcattcacacccagtcttcgaaaaaccatcaccttgtcctgaatctacactgcacttaacctatttgtttgttgcgttcttaagtgaaggaaaaatcactttcacagataaaaagcaggtctgcacagtccctctggtagaaccaaagaggtggcatcaacataaaagattttcctggtcagctcctcctgtaaaatacgtttgcctctggagatcttcctccccaatggcaccatcttgacaaaggtaaataatttcccattgagaaagaattctgtgtatctgtgtgtacatttttttggaaggtgaaagaggatgtgaaagatcagaaaagaaatattatttttattacctatttcatgaaatg

SEQ ID NO: 290582 - DNA, 670 bp, Homo sapiens
ctttccgcctcgcgttttcctccctgaccctggtcccggctcccgtccgggcgccagctggtggggcgagcgccgggagcccatctgcccccagggtgcacggggcgcggggccggctcccgcccggcacatggctgcagccacctcgctgcgcaccccgaggcgccgcgcccagctcgcccgaggtccgtcggaggcgcccggccgccccggagccaagcagcagctgagcggggaagcgcccgcgtccggggatcgggatgtccctcctcattttcctcttccagtttcctactatgttggaaccttggggactcacactgagatcaagagagtggcagaggaaaaggtcactttgccctgccaccatcaactggggcttccagaaaaagacactctggatattgaatggctgctcaccgataatgaagggaaccaaaaagtggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattccgcgggcgctacgtgtggagccatgtcatcttaaaagtcttaggtaagataggatgccaaagtg

SEQ ID NO: 290583 - DNA, 2713 bp, Homo sapiens
atgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaagaacgattacaggaagttatctatgcaatgcaaggattttgtagtgggcgtgctggacctgtgccgagacacagaagaggtggaagcaattttaaacggtgatgtgaacttccaagtctggtccgaccaccaccgtccaagtctgagccggatcaaactcgccattaaatatgaagtcaagaagttcgttgctcatcctaactgtcagcagcaattgcttaccatgtggtatgaaaatctctcaggcttacgtcaacagtctatcgctgtgaaattcctggctgtctttggagtctccataggcctcccttttctcgccatagcctattggattgctccgtgcagcaagctaggacgaaccctgaggagccctttcatgaagtttgtagctcatgcagtttcttttacaatcttcttgggattattagttgtgaatgcatctgaccgatttgaaggtgttaaaaccctgccaaacgaaaccttcacagactacccaaaacaaatcttcagagtgaaaaccacacagttctcctggacagaaatgctcattatgaagtgggtcttaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttagcagcccacatcggcgtctgtgacttctaccagcattccaaggccaggttggatgccctcgcccccatccttggtggggaggggtccccagcccactcctctaggacacgaaggggatctcctgg

SEQ ID NO: 290584 - DNA, 943 bp, Homo sapiens
  misc_feature (35)..(35): n is a, c, g, or t
  misc_feature (39)..(39): n is a, c, g, or t
  misc_feature (65)..(65): n is a, c, g, or t
aagtgcctatctgggtgaacacttaatttaggagnacanccccttctgggtgggtttttatacanaagcggtggacggcgaatctggcattgtgcatggttttagtgagagcaaactccccttctctgtgccatctgtagaaaaactacaccaagtcctgcttagaagtctgctttccgaatgttggggctgtgtctctgctcctcaggttgggctccgttgttaaatcgtggcctttgagggtgtgttgttgtttcccttgttccacaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttagcagcccacatcggcgtctgtgacttctaccagcattccaaggccaggttggatgccctcgcccccatccttggtggggaggggtccccagcccactcctctaggacacgaaggggatctcctgg

SEQ ID NO: 290585 - DNA, 4823 bp, Homo sapiens
cggccgctgcggtgacggttggcggcggccggtgaggcgggcggggccggaggcgcggaggcggggtcccgggcgagccgccctgggaggcgggggccgtttccatagcggcggcaggaggtgtcgcgccggggaacttcctggttcccgggctcggcttcgccgggatcctcttggaagggaaacaatggggcggagggcactgcggtagccgccgccgccgccgcgccgcgccgcgccggatctgctcggccgcccgggaccgccagctctgtccgctgcccacagcctagcagtcgggaccgtactgaggacatgtattcctctgagaaaccttggacagcagattttggtttaatatctgattgggacaacattcagacccatttccagtcatgaattcagaccaggatgtagcactcaaacttgcccaggagcgagctgaaatagttgctaaatatgacagaggacgagaaggtgcagagattgaaccttgggaagatgctgattaccttgtttacaaagtcacagatagatttggctttttacatgaggaggagctcccagatcataatgtggctgtggaacggcaaaagcacctggaaattgaaagaactaccaaatggctgaaaatgctgaaaggatgggaaaaatacaagaacactgaaaagtttcataggcgaatttacaaaggaataccactccagctcagaggtgaagtctgggccctccttcttgagatccctaaaatgaaagaagaaacaagggacctgtatagtaaattaaaacacagagcacggggctgttcacctgacatcagacaaatagacctggatgtcaaccgcacatttcgggaccacattatgtttagagacagatatggtgttaagcaacaatccttattccatgtgcttgctgcctattctatttataacacggaagtcgggtattgtcaggggatgagccagatcacagctttactcctcatgtatatgaacgaggaagatgccttctgggccctggtcaaactcttctcaggccctaaacatgccatgcatggcttttttgtccaaggttttcctaaactcttgaggtttcaagaacatcatgaaaaaatactgaacaaatttctgtccaagcttaagcaacacttggattctcaagaaatctacacaagtttttacacaatgaaatggttttttcagtgtttccttgatcgtactccctttacactaaacctcagaatatgggatatctacatctttgaaggagaacgagttcttactgctatgtcttacaccatcttaaaattacacaaaaaacatctaatgaaattgtccatggaagaacttgtagaattttttcaggagaccctggcaaaggattttttctttgaagatgattttgtgatagagcaacttcagatttctatgacagaactaaagcgggcaaagttagaccttccagaacctggtaaagaggatgaatatccaaagaagcccttggggcagcttccacctgaacttcagtcttggggcgtccatcacttgagcaacggacagaggagcgtgggccggccgagcccgctggccagcggcaggagggagagcggggcgccccacaggaggcacgagcactccccgcacccccagagcaggaccgggacgcccgagagagcacagccgccaagacggaaatcggtggaggaggagagcaaaaagcttaaagatgaggcagattttcaaagaaaactcccatcgggtccacaggacagttccaggcaatataatcacgcagctgccaaccaaaatagcaacgccacttcaaatatcaggaaggagtttgtgcccaaatggaataaaccgtcagacgtctcagctacagagagaactgccaaatacaccatggaaggcaaaggtcgagcagcgcaccccgcgctcgcagttaccgtcccaggtcctgccgaggtgcgggtgtcaaacgtgcggccaaagatgaaggccctggatgctgaggacgggaagcggggctccactgcatcgcagtacgacaacgtgccaggcccggagctggacagcggcgcttccgtggaggaggcgctggaaagggcttactcccagagcccccggcatgccctttaccctcccagcccgagaaagcacgctgagccaagttctagtccatcaaaagtatccaacaagtttacttttaaagtacagcctccaagtcatgcacgatatccgtcccagctagatggggaagcccgagggctagctcatcccccctcctacagcaatccccccgtttaccacggaaactctcccaaacacttccctactgccaacagcagctttgcttctccacagtttagccctgggactcaactgaatccttccaggagacctcatggttctactctttccgtcagtgcttctccggagaaatcttacagccgcccaagcccccttgtactgccgtctagtcgaatagaagtcctccctgttgacactggtgctgggggatattcgggcaattcagggtcaccaaagaatggaaaattgatcattccaccagtggattacttgccagataacagaacatggtcagaagttagttatacatacagacctgagacgcagggacaatcatggacccgagatgctagccgtggcaatttaccaaaatactcagcctttcaactcgcaccctttcaggaccatggcctccctgcagtttctgtagatagtcccgtgagatataaagcttcaccggccgcagaagatgccagtccatctggatatccatattcagggcccccgcctccagcctaccactacaggaatcgggacgggctttccatccaagagtcagtgttgctgtgagatttgacgtgtacttgctaaagacgagagagaaaccacgtgaaacctacattgctatgttcataattgccaaagcagtatttatactattgtaaacaactcgcacatctctcctgtctgttagtaataagaatacagggaaatgtcttcagccccacgtagatgctgcttaagatgagcgtttcaattgcatcatcactgacctgttagaatttaacccggaaacatcgcaatagcatttagggatgcacgcacagtggtaatttattactcagttccggttatgtttttctccaaaacctgaacatttttactctgttggctcattctattttgactaatgttacaaagtactgaaaaaactgtagaatagatatttttaaggctatatgtagtgtatgtgtcttttaatagatataggcatctgttcatccacatttgaacacagagctaaagaaacgttttttaaaaaactacttttaatccagatccatggaataatatgtaattcttgttttccttgtcttttagtccagtttttctttttccctctcatatatttgtaacctgggtcctaaactgactgaagagtttgtcctgactttattaattgcagtctcacagaatgctcatcattctccttcagctgttgccattttctttcaatctgaaaattaaagacattggagagaaaggctaaccacttaatggtgcttaaaaatcggggcacttaaaataagtttacggccaaaggtgcagcagtgcttatcacatccacatactaagagattggtcttagtgcgtttgtgccctttgttctggtctgactcttgcgaatctcagagcaggagaagttgcagcttactgatccctcagtgctcacagtactcatgtggggcagccacactaactgcattagcagtgtggttacttctttcttctgcctcgactcacatggcttctccccacgaaggtcccagggtggccatttatacaatccatttctgtcctctttatggaatgtagtcgacggatattgctgcacctcatcaggccattacattgtccatgttaaaattataaaaatgatcctagtttttcataggagtctaggattttgatcttttaaaaaatacagtgtgatttcatgcttttgaacatcttttttttttcattgaaacaaattcaagttcttggcttaaaaaaaaattagtgatgtctttaaaaaatattctgttacactacagataccaaaacactgacaaagatttaggcactccaagagagtatgacttcgtgtttaattggggagcttgttttcaacattgcttatatttgaatagtagaaaacccgacattgatgtttcttcctgttgcaaggtggggctttaaactttcaaggtacaaaagtatgtcttttaaaatggaagtaacgtttgtttagctagtgaatgtgacaatatattttatgtatataatgagtctaatgtaattttgatcaacttggtaatgatgttattaaatagcaaaacaagtgcagtgtattaaagctaaacactacattgaaacgcaaacaaaattctggtgaaataactgggctgttgatgcaggtcaggtggaagctgagaaataaatgtatataaatatgtagctgaggatattaattcccattatataaccataattctgtgacttgtaataaaccaagctgtacaatttagtttataatagcagtatctgagctgctccaaaatatatatatcaacagtggtaaatactgtagatttttatatatatatatatatatataatatatatatgcaaaaaatatatatatacacacaagcactattttcttatgtcatttatgacattttttatctgtatacttttttgatgtgattgttttttaacatgctaaaagtaataagtaaattttgt

SEQ ID NO: 290586 - DNA, 1923 bp, Homo sapiens
cggccgctgcggtgacggttggcggcggccggtgaggcgggcggggccggaggcgcggaggcggggtcccgggcgagccgccctgggaggcgggggccgtttccatagcggcggcaggaggtgtcgcgccggggaacttcctggttcccgggctcggcttcgccgggatcctcttggaagggaaacaatggggcggagggcactgcggtagccgccgccgccgccgcgccgcgccgcgccggatctgctcggccgcccgggaccgccagctctgtccgctgcccacagcctagcagtcgggaccgtactgaggacatgtattcctctgagaaaccttggacagcagattttggtttaatatctgattgggacaacattcagacccatttccagtcatgaacggagtcttgccctgtcacccaggctggagtgcagtggcgcaatctcggctcactgcaagctccgcctcctaggttgacaccattctcctgcctcagcctcccaagtagctgggactacaggaacccgccaccacgcccagctaatctttttgtatttttagtagagacatggtttcaccatgttagccaggatggtctcgatctcctgacctcgtgatccacccgcctcggcctcccaaagtgctgggattataggtgtgagccactacgcccggcctggatgctacattcttaaaggatgctgattttatcttggtttcttgcttttttaagttatctctcatgttctttgatttgctctatgttgcttctttctgtggtcttcttgggtatactcaagtgtgtatcgcatatgtttaacaaaggaaaaatagtgttaaaagaaaaagtatcacttaatataagaagcaaaacttagtttttgtttctatgatagtgacatccaggtatgatttaggttatttttcactttaaacgggctattaacttcacgtgagaaaaaaactgtagaaacgttaactcctgtagaatgatgactatctgtggtgtagtaagatcatacaacttctctacttgttactgtgagttgcttaataaatggcagtacaagtgtcaaatccataattagtcaatatcaagagctgcattttggattgcatgtactgtcccaaatatatgttgtgcaagttactttgtatcatgttaatggagaaaagagtggatattatgaaatcagcaatataaatcaaatgtatatgtggtcctgcaatgtaattgaaggtactcagtgttctcagacactcatgcaatatcttgtgttgctttctcagattttttaggtgtatcataggggatagctgggaactggtagagcagaggtactaagttccacctggaaatgctttagagtagctctttgaatatgtctttacttattatcttacagcgtatgtgtatatgattattttctagagggtcgtaccctttattaagctgtgagcttcttgagggcaaggactgcaattcattaatcattttggagaaaagtgaataattctgaagaattcggtggttcatgagcttgcctggtatttgtttctctatggcttatcatctaagtgagataacagatagtagataattgataaatttaatctgttacctaattactgagaggattcgattcttgctttatgttattactgaaacagactgcccagtaatcttctctagagagcaattaggtttgcaatgagttattttattgagaatgctacttgaaattaaatgtttatagcactatcttgatataatttaaatataatttaaatgtgctgaagtatcttcattcagataacttgttaccccttaacaaaaggctgcttgagtattgtttctctcccatttggcaaacaccagatgcagtgattaataaaggtcattatgctacttaaaaaaaaaa

SEQ ID NO: 290587 - DNA, 606 bp, Homo sapiens
cggccgctgcggtgacggttggcggcggccggtgaggcgggcggggccggaggcgcggaggcggggtcccgggcgagccgccctgggaggcgggggccgtttccatagcggcggcaggaggtgtcgcgccggggaacttcctggttcccgggctcggcttcgccgggatcctcttggaagggaaacaatggggcggagggcactgcggtagccgccgccgccgccgcgccgcgccgcgccggatctgctcggccgcccgggaccgccagctctgtccgctgcccacagcctagcagtcgggaccgtactgaggacatgtattcctctgagaaaccttggacagcagattttggtttaatatctgattgggacaacattcagacccatttccagtcatgagttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggta

SEQ ID NO: 290588 - DNA, 4770 bp, Homo sapiens
cggccgctgcggtgacggttggcggcggccggtgaggcgggcggggccggaggcgcggaggcggggtcccgggcgagccgccctgggaggcgggggccgtttccatagcggcggcaggaggtgtcgcgccggggaacttcctggttcccgggctcggcttcgccgggatcctcttggaagggaaacaatggggcggagggcactgcggtagccgccgccgccgccgcgccgcgccgcgccggatctgctcggccgcccgggaccgccagctctgtccgctgcccacagcctagcagtcgggaccgtactgaggacatgtattcctctgagaaaccttggacagcagattttggtttaatatctgattgggacaacattcagacccatttccagtcatgaattcagaccaggatgtagcactcaaacttgcccaggagcgagctgaaatagttgctaaatatgacagaggacgagaaggtgcagagattgaaccttgggaagatgctgattaccttgtttacaaagtcacagatagatttggctttttacatgaggaggagctcccagatcataatgtggctgtggaacggcaaaagcacctggaaattgaaagaactaccaaatggctgaaaatgctgaaaggatgggaaaaatacaagaacactgaaaagtttcataggcgaatttacaaaggaataccactccagctcagaggtgaagtctgggccctccttcttgagatccctaaaatgaaagaagaaacaagggacctgtatagtaaattaaaacacagagcacggggctgttcacctgacatcagacaaatagacctggatgtcaaccgcacatttcgggaccacattatgtttagagacagatatggtgttaagcaacaatccttattccatgtgcttgctgcctattctatttataacacggaagtcgggtattgtcaggggatgagccagatcacagctttactcctcatgtatatgaacgaggaagatgccttctgggccctggtcaaactcttctcaggccctaaacatgccatgcatggcttttttgtccaaggttttcctaaactcttgaggtttcaagaacatcatgaaaaaatactgaacaaatttctgtccaagcttaagcaacacttggattctcaagaaatctacacaagtttttacacaatgaaatggttttttcagtgtttccttgatcgtactccctttacactaaacctcagaatatgggatatctacatctttgaaggagaacgagttcttactgctatgtcttacaccatcttaaaattacacaaaaaacatctaatgaaattgtccatggaagaacttgtagaattttttcaggagaccctggcaaaggattttttctttgaagatgattttgtgatagagcaacttcagatttctatgacagaactaaagcgggcaaagttagaccttccagaacctggtaaagaggatgaatatccaaagaagcccttggggcagcttccacctgaacttcagtcttggggcgtccatcacttgagcaacggacagaggagcgtgggccggccgagcccgctggccagcggcaggagggagagcggggcgccccacaggaggcacgagcactccccgcacccccagagcaggaccgggacgcccgagagagcacagccgccaagacggaaatcggtggaggaggagagcaaaaagcttaaagatgaggcagattttcaaagaaaactcccatcgggtccacaggacagttccaggcaatataatcacgcagctgccaaccaaaatagcaacgccacttcaaatatcaggaaggagtttgtgcccaaatggaataaaccgtcagacgtctcagctacagagagaactgccaaatacaccatggaaggcaaaggtcgagcagcgcaccccgcgctcgcagttaccgtcccaggtcctgccgaggtgcgggtgtcaaacgtgcggccaaagatgaaggccctggatgctgaggacgggaagcggggctccactgcatcgcagtacgacaacgtgccaggcccggagctggacagcggcgcttccgtggaggaggcgctggaaagggcttactcccagagcccccggcatgccctttaccctcccagcccgagaaagcacgctgagccaagttctagtccatcaaaagtatccaacaagtttacttttaaagtacagcctccaagtcatgcacgatatccgtcccagctagatggggaagcccgagggctagctcatcccccctcctacagcaatccccccgtttaccacggaaactctcccaaacacttccctactgccaacagcagctttgcttctccacagtttagccctgggactcaactgaatccttccaggagacctcatggttctactctttccgtcagtgcttctccggagaaatcttacagccgcccaagcccccttgtactgccgtctagtcgaatagaagtcctccctgttgacactggtgctgggggatattcgggcaattcagggtcaccaaagaatggaaaattgatcattccaccagtggattacttgccagataacagaacatggtcagaagttagttatacatacagacctgagacgcagggacaatcatggacccgagatgctagccgtggcaatttacctttctgtagatagtcccgtgagatataaagcttcaccggccgcagaagatgccagtccatctggatatccatattcagggcccccgcctccagcctaccactacaggaatcgggacgggctttccatccaagagtcagtgttgctgtgagatttgacgtgtacttgctaaagacgagagagaaaccacgtgaaacctacattgctatgttcataattgccaaagcagtatttatactattgtaaacaactcgcacatctctcctgtctgttagtaataagaatacagggaaatgtcttcagccccacgtagatgctgcttaagatgagcgtttcaattgcatcatcactgacctgttagaatttaacccggaaacatcgcaatagcatttagggatgcacgcacagtggtaatttattactcagttccggttatgtttttctccaaaacctgaacatttttactctgttggctcattctattttgactaatgttacaaagtactgaaaaaactgtagaatagatatttttaaggctatatgtagtgtatgtgtcttttaatagatataggcatctgttcatccacatttgaacacagagctaaagaaacgttttttaaaaaactacttttaatccagatccatggaataatatgtaattcttgttttccttgtcttttagtccagtttttctttttccctctcatatatttgtaacctgggtcctaaactgactgaagagtttgtcctgactttattaattgcagtctcacagaatgctcatcattctccttcagctgttgccattttctttcaatctgaaaattaaagacattggagagaaaggctaaccacttaatggtgcttaaaaatcggggcacttaaaataagtttacggccaaaggtgcagcagtgcttatcacatccacatactaagagattggtcttagtgcgtttgtgccctttgttctggtctgactcttgcgaatctcagagcaggagaagttgcagcttactgatccctcagtgctcacagtactcatgtggggcagccacactaactgcattagcagtgtggttacttctttcttctgcctcgactcacatggcttctccccacgaaggtcccagggtggccatttatacaatccatttctgtcctctttatggaatgtagtcgacggatattgctgcacctcatcaggccattacattgtccatgttaaaattataaaaatgatcctagtttttcataggagtctaggattttgatcttttaaaaaatacagtgtgatttcatgcttttgaacatcttttttttttcattgaaacaaattcaagttcttggcttaaaaaaaaattagtgatgtctttaaaaaatattctgttacactacagataccaaaacactgacaaagatttaggcactccaagagagtatgacttcgtgtttaattggggagcttgttttcaacattgcttatatttgaatagtagaaaacccgacattgatgtttcttcctgttgcaaggtggggctttaaactttcaaggtacaaaagtatgtcttttaaaatggaagtaacgtttgtttagctagtgaatgtgacaatatattttatgtatataatgagtctaatgtaattttgatcaacttggtaatgatgttattaaatagcaaaacaagtgcagtgtattaaagctaaacactacattgaaacgcaaacaaaattctggtgaaataactgggctgttgatgcaggtcaggtggaagctgagaaataaatgtatataaatatgtagctgaggatattaattcccattatataaccataattctgtgacttgtaataaaccaagctgtacaatttagtttataatagcagtatctgagctgctccaaaatatatatatcaacagtggtaaatactgtagatttttatatatatatatatatatataatatatatatgcaaaaaatatatatatacacacaagcactattttcttatgtcatttatgacattttttatctgtatacttttttgatgtgattgttttttaacatgctaaaagtaataagtaaattttgt

SEQ ID NO: 290589 - DNA, 4363 bp, Homo sapiens
cggccgctgcggtgacggttggcggcggccggtgaggcgggcggggccggaggcgcggaggcggggtcccgggcgagccgccctgggaggcgggggccgtttccatagcggcggcaggaggtgtcgcgccggggaacttcctggttcccgggctcggcttcgccgggatcctcttggaagggaaacaatggggcggagggcactgcggtagccgccgccgccgccgcgccgcgccgcgccggatctgctcggccgcccgggaccgccagctctgtccgctgcccacagcctagcagtcgggaccgtactgaggacatgtattcctctgagaaaccttggacagcagattttggtttaatatctgattgggacaacattcagacccatttccagtcatgaattcagaccaggatgtagcactcaaacttgcccaggagcgagctgaaatagttgctaaatatgacagaggacgagaaggtgcagagattgaaccttgggaagatgctgattaccttgtttacaaagtcacagatagatttggctttttacatgaggaggagctcccagatcataatgtggctgtggaacggcaaaagcacctggaaattgaaagaactaccaaatggctgaaaatgctgaaaggatgggaaaaatacaagaacactgaaaagtttcataggcgaatttacaaaggaataccactccagctcagaggtgaagtctgggccctccttcttgagatccctaaaatgaaagaagaaacaagggacctgtatagtaaattaaaacacagagcacggggctgttcacctgacatcagacaaatagacctggatgtcaaccgcacatttcgggaccacattatgtttagagacagatatggtgttaagcaacaatccttattccatgtgcttgctgcctattctatttataacacggaagtcgggtattgtcaggggatgagccagatcacagctttactcctcatgtatatgaacgaggaagatgccttctgggccctggtcaaactcttctcaggccctaaacatgccatgcatggcttttttgtccaaggttttcctaaactcttgaggtttcaagaacatcatgaaaaaatactgaacaaatttctgtccaagcttaagcaacacttggattctcaagaaatctacacaagtttttacacaatgaaatggttttttcagtgtttccttgatcgtactccctttacactaaacctcagaatatgggatatctacatctttgaaggagaacgagttcttactgctatgtcttacaccatcttaaaattacacaaaaaacatctaatgaaattgtccatggaagaacttgtagaattttttcaggagaccctggcaaaggattttttctttgaagatgattttgtgatagagcaacttcagatttctatgacagaactaaagcgggcaaagttagaccttccagaacctggtaaagaggatgaatatccaaagaagcccttggggcagcttccacctgaacttcagtcttggggcgtccatcacttgagcaacggacagaggagcgtgggccggccgagcccgctggccagcggcaggagggagagcggggcgccccacaggaggcacgagcactccccgcacccccagagcaggaccgggacgcccgagagagcacagccgccaagacggaaatcggtggaggaggagagcaaaaagcttaaagatgaggcagattttcaaagaaaactcccatcgggtccacaggacagttccaggcaatataatcacgcagctgccaaccaaaatagcaacgccacttcaaatatcaggaaggagtttgtgcccaaatggaataaaccgtcagacgtctcagctacagagagaactgccaaatacaccatggaaggcaaaggtcgagcagcgcaccccgcgctcgcagttaccgtcccaggtcctgccgaggtgcgggtgtcaaacgtgcggccaaagatgaaggccctggatgctgaggacgggaagcggggctccactgcatcgcagtacgacaacgtgccaggcccggagctggacagcggcgcttccgtggaggaggcgctggaaagggcttactcccagagcccccggcatgccctttaccctcccagcccgagaaagcacgctgagccaagttctagtccatcaaaagtatccaacaagtttacttttaaagtacagcctccaagtcatgcacgatatccgtcccagctagatggggaagcccgagggctagctcatcccccctcctacagcaatccccccgtttaccacggaaactctcccaaacacttccctactgccaacagcagctttgcttctccacagtttagccctgggactcaactgaatccttccaggagacctcatggttctactctttccgtcagtgcttctccggagaaatcttacagccgcccaagcccccttgtactgccgtctagtcgaatagaagtcctccctgttgacactggtgctgggggatattcgggcaattcagggtcaccaaagaatggaaaattgatcattccaccagtggattacttgccagataacagaacatggtcagaagttagttatacatacagacctgagacgcagggacaatcatggacccgagatgctagccgtggcaatttaccaaaatactcagcctttcaactcgcaccctttcaggaccatggcctccctgcagtttctgtagatagtcccgtgagatataaagcttcaccggccgcagaagatgccagtccatctggatatccatattcagggcccccgcctccagcctaccactacaggaatcgggacgggctttccatccaagagtcagtgttgctgtgagatttgacgtgtacttgctaaagacgagagagaaaccacgtgaaacctacattgctatgttcataattgccaaagcagtatttatactattgtaaacaactcgcacatctctcctgtctgttagtaataagaatacagggaaatgtcttcagccccacgtagatgctgcttaagatgagcgtttcaattgcatcatcactgacctgttagaatttaacccggaaacatcgcaatagcatttagggatgcacgcacagtggtaatttattactcagttccggttatgtttttctccaaaacctgaacatttttactctgttggctcattctattttgactaatgttacaaagtactgaaaaaactgtagaatagatatttttaaggctatatgtagtgtatgtgtcttttaatagatataggcatctgttcatccacatttgaacacagagctaaagaaacgttttttaaaaaactacttttaatccagatccatggaataatatgtaattcttgttttccttgtcttttagtccagtttttctttttccctctcatatatttgtaacctgggtcctaaactgactgaagagtttgtcctgactttattaattgcagtctcacagaatgctcatcattctccttcagctgttgccattttctttcaatctgaaaattaaagacattggagagaaaggctaaccacttaatggtgcttaaaaatcggggcacttaaaataagtttacggccaaaggtgcagcagtgcttatcacatccacatactaagagattggtcttagtgcgtttgtgccctttgttctggtctgactcttgcgaatctcagagcaggagaagttgcagcttactgatccctcagtgctcacagtactcatgtggggcagccacactaactgcattagcagtgtggttacttctttcttctgcctcgactcacatggcttctccccacgaaggtcccagggtggccatttatacaatccatttctgtcctctttatggaatgtagtcgacggatattgctgcacctcatcaggccattacattgtccatgttaaaattataaaaatgatcctagtttttcataggagtctaggattttgatcttttaaaaaatacagtgtgatttcatgcttttgaacatcttttttttttcattgaaacaaattcaagttcttggcttaaaaaaaaattagtgatgtctttaaaaaatattctgttacactacagataccaaaacactgacaaagatttaggcactccaagagagtatgacttcgtgtttaattggggagcttgttttcaacattgcttatatttgaatagtagaaaacccgacattgatgtttcttcctgttgcaaggtggggctttaaactttcaaggtacaaaagtatgtcttttaaaatggaagtaacgtttgtttagctagtgaatgtgacaatatattttatgtatataatga

SEQ ID NO: 290590 - DNA, 689 bp, Homo sapiens
tctctgctatcctctgacctgccggctggacacgccaatgtcgctcgtttgcgtgccccgaagccccgctttgggtcctgggcttccagcgcccgcttcccgccgaggggctccgggcacctgcagccctgggcgcgcgtccccgaggcgggcgggagcgcgcacggcgggagtgcgggagcggagcgcacgtgccgccgggaaggggccgcgccaatatggcggcggctgcggccgctgcggtgacggttggcggcggccggtgaggcgggcggggccggaggcgcggaggcggggtcccgggcgagccgccctgggaggcgggggccgtttccatagcggcggcaggaggtgtcgcgccggggaacttcctggttcccgggctcggcttcgccgggatcctcttggaagggaaacaatggggcggagggcactgcggtagccgccgccgccgccgcgccgcgccgcgccggatctgctcggccgcccgggaccgccagctctgtccgctgcccacagcctagcagtcgggaccgtactgaggtaacttccattcctcagctcccgccgtgaggggccggcggcggcgggctccgcgggcgtcctccccgggccgggactcggagttggccccggggagccggacgccgccattcccggcccctggaggaggggacgcggctgcggtt

SEQ ID NO: 290591 - DNA, 1978 bp, Homo sapiens
  misc_feature (3)..(3): n is a, c, g, or t
ggncgggcccacggccgcggcagtggatggggttgagctcgtcctgggggaaggcgtgagccatgtagttgtcgtagccaaagacgaacatgccccgtgccaggtcgcgcatctgggcacgcagctgcggagggaaggcgccgctgtagcgcttctcgtactcgtccgggccgcggccccggccgcccagcacgtagccccagttggctgggccgcacatccccggcccaggacgccgcggagccttgcgcgggctctgcgctgccccggtccccggcggctgcagccacgacggcccggatacccccccaggccggcccacgggccccgaggtgggcgacgcggggccgtcggggctcctcagacgctggaagccgaagctgagcggaaagcgctggtagaagcccatgctgggccccagcccgaagacgagccacaatactccatggaggccaagccggaggagcaccagccccaggacgagcgctcgccattgcatggtcgcgcgggcgccgcgggcattattttaaagcgcgggggcctccccgccgaccaccgcaccccgcgctcgccccgtagcccggctcgcttcccctttaaggaactcccccgtgacgcaccaggaactagcccatcgtccccaacccccaggctctccggcgggccggccaggccccacggtcgcccgcccagtggcccgggattggcccggcctgggcccggcctcgcggggcgcggcccaggactccctcccacgcagtaggccgccaggacgtccgcgacgccccgaggccccgcccctcacccgggccccgccccaactcccaagccccgcccccctgggcggtccgtagcccgatgggctggcgtggcgagcaggagccgcgccggcccgcgagggaacttccagccaatgggagagcggcacggcagcgcccgccggacgctggacacagacgtgaccccagaccgcctggccttgggtggatcgggtctctgggcagagcgtgtgtccggcagagctaggaccggaaaaagccactctaggtctaggttaggagtgatgacagttaaaagatatataaggaaaagaaggaaaggatcgtttctgtataaaacgagctatttttgcatatcgagcgcataagttttataacttaggtgtctgtttatggagagggtgggatactaccttttagctcaaggagtgcacaaaacggtatcatgaattctgctcttttgattcaaacacccaactttgaagaatcgctcatggtgcttgtaaaacacgtatccccagatccctccctagacctatcgaacaactccaacggtctcgggaatgtgcgtggtttctgaaaagcttgggaagcaagacctgactagacccccaaatctgatattggctgaatggccgaccaatggagtgcataagaagtctggatacaaaggcagcccaatttctagaaatgtataccagccatgaagagataaagctccaagaggagatttctctttctggtataaggatttaaacaaaacctagaatgtcgcagtactcgaagtatccaaaacaactgaaaaatgaagaagaataaaagaagaatccaaaagtatccaaaataactgaacatatgaagaatcatggctgggcacagtgactggctcatgtccgtaatcctagcattttgggaggctgggggcggggaggcagggacagggatcacttgaggtcaggatttcaagaccagcctggccaacatggtgaaatcccatctctactaaaaacacaaaaattagctgggtgtggtggcgcatgcctgaaatcccatttgaggccgggcatggtggctcaggcctataataccagcactttgggaggccaaggcgggtggatcacttgaggtcaggagttggagaccagcatggccaacatggcaaaaccccatctctactgaaaatacaaaaattcactggg

SEQ ID NO: 290592 - DNA, 899 bp, Homo sapiens
gcgattccttctcctaccttgtggcccctgagacagattcaactgagggaaaggcaggagcctcaagctttccaggctcaggaccaggaagtgggagatgggagactaagacagtatcaaggaaactcagaagggaacgaactggagtaatacatctgataaagttgtgtatgaactcctgggctcacccccaagctgtgacatatggatctgatcccaacagcacaaaggctttgagaactaaactataaggtagaccaccacccaagtgcctggttgacccctgtgtggcacatagccagaaatgacccaaatagcaccagcaaggctttgaaaactaacatcatattagaaccaaagcccatagaaggtgggttggatcttgtggcctaaactgagttaactgtctgctataacaaaacaaaataacaaatcaatattctccacaggatttaaacaaaacctagaatgtcgcagtactcgaagtatccaaaacaactgaaaaatgaagaagaataaaagaagaatccaaaagtatccaaaataactgaacatatgaagaatcatggctgggcacagtgactggctcatgtccgtaatcctagcattttgggaggctgggggcggggaggcagggacagggatcacttgaggtcaggatttcaagaccagcctggccaacatggtgaaatcccatctctactaaaaacacaaaaattagctgggtgtggtggcgcatgcctgaaatcccatttgaggccgggcatggtggctcaggcctataataccagcactttgggaggccaaggcgggtggatcacttgaggtcaggagttggagaccagcatggccaacatggcaaaaccccatctctactgaaaatacaaaaattcactggg

SEQ ID NO: 290593 - DNA, 1132 bp, Homo sapiens
  misc_feature (3)..(3): n is a, c, g, or t
ggncgggcccacggccgcggcagtggatggggttgagctcgtcctgggggaaggcgtgagccatgtagttgtcgtagccaaagacgaacatgccccgtgccaggtcgcgcatctgggcacgcagctgcggagggaaggcgccgctgtagcgcttctcgtactcgtccgggccgcggccccggccgcccagcacgtagccccagttggctgggccgcacatccccggcccaggacgccgcggagccttgcgcgggctctgcgctgccccggtccccggcggctgcagccacgacggcccggatacccccccaggccggcccacgggccccgaggtgggcgacgcggggccgtcggggctcctcagacgctggaagccgaagctgagcggaaagcgctggtagaagcccatgctgggccccagcccgaagacgagccacaatactccatggaggccaagccggaggagcaccagccccaggacgagcgctcgccattgcatggtcgcgcgggcgccgcgggcattattttaaagcgcgggggcctccccgccgaccaccgcaccccgcgctcgccccgtagcccggctcgcttcccctttaaggaactcccccgtgacgcaccaggaactagcccatcgtccccaacccccaggctctccggcgggccggccaggccccacggtcgcccgcccagtggcccgggattggcccggcctgggcccggcctcgcggggcgcggcccaggactccctcccacgcagtaggccgccaggacgtccgcgacgccccgaggccccgcccctcacccgggccccgccccaactcccaagccccgcccccctgggcggtccgtagcccgatgggctggcgtggcgagcaggagccgcgccggcccgcgagggaacttccagccaatgggagagcggcacggcagcgcccgccggacgctggacacagacgtgaccccagaccgcctggccttgggtggatcgggtctctgggcagagcgtgtgtccggcagagctaggaccggaaaaagccactctaggtctaggttaggagtgatgacagttaaaagatatataaggaaaagaaggaaaggatcgtttctgtataaaacgagctatttttgc

SEQ ID NO: 290594 - DNA, 495 bp, Homo sapiens
gtgattgccacatctcggattcgccgcggggcaactacctgggaaaaccgcagactgggcaatgaaagactacatccggcaaccggatgctgggttctgtgactccaggaaaaggggctcctgggcccagggagaacatactaggcgatctcgacagtcgctccgtgacagcccaccaacccccaaccctctacctcgcagccaccctaaaggcgacttcaagaagatggaaggatctcacggatctcattcctaatggtccgccgaagtctcacacagtagacagacggagttgagatgctggaggatgcagtcacctcctaaacttacgacccaccaccagacttcatcccagccgggacgtcctcccccacccgagtcctccccatttcttctcctactttgccgcagttccaggtgtcctgcttccaccagtcccacaaagctcaataaataccaagagacctgcatttacagcagggggaacatctcaca

SEQ ID NO: 290595 - DNA, 394 bp, Homo sapiens
cagacagtaaatcaattttatttgtgttcacagaacatactaggcgatctcgacagtcgctccgtgacagcccaccaacccccaaccctctacctcgcagccaccctaaaggcgacttcaagaagatggaaggatctcacggatctcattcctaatggtccgccgaagtctcacacagtagacagacggagttgagatgctggaggatgcagtcacctcctaaacttacgacccaccaccagacttcatcccagccgggacgtcctcccccacccgagtcctccccatttcttctcctactttgccgcagttccaggtgtcctgcttccaccagtcccacaaagctcaataaataccaagagacctgcatttacagcagggggaacatctcaca

SEQ ID NO: 290596 - DNA, 865 bp, Homo sapiens
gaacacatagctaggttagagcatgcgtttaaattcggacgggtgccctgctgagcgggtgttgcccttgccgctgtcctgtgacgtagcccttttcaaaaccacctctcccaagtgctgcaccactcctcctccatgcccagggaccgcgggtgcttggggccccgacgcgtacccaggtgccatctggccctcacctcccgccgtagctggctgtgacgcccgccatgggcacactggggcagtgcagtgagaagacgaggatgcccagcaggctgacaacggtgcagaacaggcagaacttgatgaccgcggagccccggagcctgagcttgttcacaaagaagccgcccaggaaggtgccgccaccacccgctggcaccaccagtgtcgctgacttgaacccctgcgtctgcagcttagtgacatcctgtaaacctacactttccagcctctcaccagagcagactgtcggcctcacatcacccccacctgcaggagggcggctctttcctctcggccacacctagagcctggttccgatgaacgcaactctgaatgcctggaacattcaaatgctcttgtttgaggaggtggccaaatgtaaatggattctgaagaatcaggaacagacggtgcagccctagttagcctctgagccccaacaggcccacaggtgccttgcagagctgatgttggcgtcagaaactccgctccagcctcacaggcactctgcctgcttggaggtgttcgctggctcgctcagactgacctcagcagccatgaacatgggttctttctgtccccttccctgattaaaatgggagagcccagttctttcaaaatttatttcctgacttgagga

SEQ ID NO: 290597 - DNA, 750 bp, Homo sapiens
gggacagaaagaacccatgttcatggctgctgaggtcactctgagcgagccagcgcacacctccaagcaggcagagtgcctgtgaggctggagcggagtttctgacgccaacatcagctctgcaaggcacctgtgggcctgttggggctcagacggctaacttggggctgaacgtggacatgccggtgatgagagtggcctcggtggccccggccaggcagagcaggatgaacgtggggttcttcagcaggagccagatggagctgggcagagtgtcgctgacttgaacccctgcgtctgcagcttagtgacatcctgtaaacctacactttccagcctctcaccagagcagactgtcggcctcacatcacccccacctgcaggagggcggctctttcctctcggccacacctagagcctggttccgatgaacgcaactctgaatgcctggaacattcaaatgctcttgtttgaggaggtggccaaatgtaaatggattctgaagaatcaggaacagacggtgcagccctagttagcctctgagccccaacaggcccacaggtgccttgcagagctgatgttggcgtcagaaactccgctccagcctcacaggcactctgcctgcttggaggtgttcgctggctcgctcagactgacctcagcagccatgaacatgggttctttctgtccccttccctgattaaaatgggagagcccagttctttcaaaatttatttcctgacttgagga

SEQ ID NO: 290598 - DNA, 875 bp, Homo sapiens
gaacacatagctaggttagagcatgcgtttaaattcggacgggtgccctgctgagcgggtgttgcccttgccgctgtcctgtgacgtagcccttttcaaaaccacctctcccaagtgctgcaccactcctcctccatgcccagggaccgcgggtgcttggggccccgacgcgtacccaggtgccatctggccctcacctcccgccgtagctggctgtgacgcccgccatgggcacactggggcagtgcagtgagaagacgaggatgcccagcaggctgacaacggtgcagaacaggcagaacttgatgaccgcggagccccggagcctgagcttgttcacaaagaagccgcccaggaaggtgccgccaccacccgctggcaccaccagggcagccacaccccctcctcccccaggggcctctgccgagtccctgcaggctgtgacaaggacatttgtcgaagcctgagtggccaccaacagtaaaaaattgcgattagctggcatctagcttctgggctgacaagtgaggagggcacagacctgcccagcctgggaaggccagcctgcctctggcaccgagaaacccccagctgcactgttccaggaggtcctgaggcaccagtgcctggctcatggaacagccaggtccaaacccttcctgcaccaagtcacagaagccaagactaggtggctagggggtggagcccaccgtggacccttccacctacggagcatgtcccacaaagagggcaggaccaccactctcccggcctgtggacagagtcgctcagcccccgtggcgctctccacacctgctctggcagcgggggtgggagggcactcactgccatgtgccctgtctgggtctttctag

SEQ ID NO: 290599 - DNA, 802 bp, Homo sapiens
gaacacatagctaggttagagcatgcgtttaaattcggacgggtgccctgctgagcgggtgttgcccttgccgctgtcctgtgacgtagcccttttcaaaaccacctctcccaagtgctgcaccactcctcctccatgcccagggaccgcgggtgcttggggccccgacgcgtacccaggtgccatctggccctcacctcccgccgtagctggctgtgacgcccgccatgggcacactggggcagtgcagtgagaagacgaggatgcccagcaggctgacaacggtgcagaacaggcagaacttgatgaccgcggagccccggagcctgagcttgttcacaaagaagccgcccaggaaggtgccgccaccacccgctggcaccaccagcctctcaccagagcagactgtcggcctcacatcacccccacctgcaggagggcggctctttcctctcggccacacctagagcctggttccgatgaacgcaactctgaatgcctggaacattcaaatgctcttgtttgaggaggtggccaaatgtaaatggattctgaagaatcaggaacagacggtgcagccctagttagcctctgagccccaacaggcccacaggtgccttgcagagctgatgttggcgtcagaaactccgctccagcctcacaggcactctgcctgcttggaggtgttcgctggctcgctcagactgacctcagcagccatgaacatgggttctttctgtccccttccctgattaaaatgggagagcccagttctttcaaaatttatttcctgacttgagga

SEQ ID NO: 290600 - DNA, 657 bp, Homo sapiens
gtggttggggcaaagcgccagtaatggagaagcagagcccagcgcttggtgtgacggggtcccaggtagtcgacacactcttccccctcggccgcccccgccggaacttccgttcgagtcccgggaacccagccatcgcgctgccggaagtagcctggccgacagtacggaacccggaagcggggacccggcttcgctggatagaagctgccatgttggaggcggcggggctactccctgtcattcagccgcgcagtcgctgggttctcacccgctcccaccttgtagattcgagacagggcacccaagactcccacttgctaccaccacccatgcgcctcctggaggagggccgaccggaaggagaggcatccctcacactattgtttgcataaactttaccaccttcccatcctcatgggacacacctcttaaggcctcgggtgtctgccactggctttcatgccctattccaggatcatgaatggaatgacacactctgaaccgaagagaccttacagatcatctagttctccagccttgaagatggggaaactgaggctcaaggaaggcatgtaaacagcaacctcgggattccatttaaattctgcctctctggatctgcttcctgatatataaaatggtaataaccaaaat

SEQ ID NO: 290601 - DNA, 253 bp, Homo sapiens
gtggttggggcaaagcgccagtaatggagaagcagagcccagcgcttggtgtgacggggtcccaggtagtcggatcatgaatggaatgacacactctgaaccgaagagaccttacagatcatctagttctccagccttgaagatggggaaactgaggctcaaggaaggcatgtaaacagcaacctcgggattccatttaaattctgcctctctggatctgcttcctgatatataaaatggtaataaccaaaat

SEQ ID NO: 290602 - DNA, 241 bp, Homo sapiens
agaacaacagaaaggtggagtcaaggaacttcccaatagatgagagtggagtctcgggcacggggtggagttaatcggaggggtggagaaactgaaggctctaagtatggtttaggatgagggagggggaataaggaattgagatgtgagacggagcttaggtgatggaggcaaagtgaacggactctattaaaagaccgggtgtagcaaccccagggtgtgggaggggagggggtgcaag

SEQ ID NO: 290603 - DNA, 525 bp, Homo sapiens
attctcactttccctttgcattctgttagaatggtcctgtgtctgaattccccttggaatttggatagatttaaaagtgataggaataagtagctggtctttctagcctccgcctccaggcgggtgaggaggtgacacctgagaattcctccctctcacccctgaccctgccggaaagcgaaactgagatgcgggcattgggccctgggaagcgtggggaaggggaaaggagaaagccaggtgggtttttaggtcccttccagtgccacactgtggggtgttgaggggccgcgcgaggcaggcccttccatgaggcctggactggaggccttctctaggcgccggcgctggcctgggccgcctgccgccacgcaggggccgcacgcctgggccccagggcccctttgccggcgggaggccggggggaccgactgctcttggcgcccggggtcaggggaggccgggaaacctcggctcccgggcgacaggcacccaggcccttctcagccccccggccgcggccgc

SEQ ID NO: 290604 - DNA, 2426 bp, Homo sapiens
  misc_feature (1508)..(1508): n is a, c, g, or t
  misc_feature (1639)..(1639): n is a, c, g, or t
attctcactttccctttgcattctgttagaatggtcctgtgtctgaattccccttggaatttggatagatttaaaagtgataggaataagtagctggtctttctagcctccgcctccaggcgggtgaggaggtgacacctgagaattcctccctctcacccctgaccctgccggaaagcgaaactgagatgcgggcattgggccctgggaagcgtggggaaggggaaaggagaaagccagaaaatggagaaattaagtcctttccatggatcattccttctgtaaacagagatcacaaagcaagagcttcagcatcctcgtgaaaaagacattttgttctgggtgtcatcatctccttccactacagcttgcaattggaacaagcttcacatcctgggggtgctgcctatctctgtcttgatttctgtctgtctattcctcccattgacaggaatgtcgtttgtatcctccacgcagcagtttgcagaaatccagcaaggtttatggtttatgttgcccagcatgtataaacacaacgctctcaaatgctttttaaaaatctatgaatttgttagatgtcttcacatcctggtcctcctaccccaattctcaaacacaaagtactctgttgccctattatagtcctgcgatagttctggctaggattaggttgacggtctaagccccaagaaaggcctggcattttcatagcaggctttccccagtgctttgagtcttcctctctcactccctttttctttttccctcggaggagggggtgttgggggtgggaggtgattagtaaatgtttcaggtaatctgtgaattcttaatagtcatatttccgtggtggaagatctccctatttctctgatgtgacaggttacagaaaccttggtgttgggggttttacagatatttacaagttctaggagtttgaactttgggtcaagatgttgattccttttaatgtgcgagggtgaaggaggttttattttgctttattcttttggatattatgagatgagattgtatccagtcttggctgtaacctataccataaatgcagagctgcaaccattatttctgtctctttctccttttatcacctacacttctagagatattactttcagttttattgcaaatcatctgtgtctttagtttaaaccattatttttcatataccccaggcacatttcccttataatgagacaaattttagattattaatgttccacctaaaaggatactgtacacttttcattgccaatatgggctttgaagcttaaatatcaacatttttataggaaatttacccatgtcaaatttaaatatatttgcttatatttcttggaaaaaagattttggataactatcaattaagcagccaattccatttggggtgcagaaaattttgagccccttgataagaaggaacaaaatttttcctctaaataaccaactctggatcagaaaaactgaacttttctaaatatttattattnacaaaacttttttttgtctgattccactagaagcattctatgttgtgaacactataaagttatcctatgttgtgaacaccataaagttatgagggaaaaaatgtcaaatctaaattttatttagaagtaanatattgtttttctggacttgcaatccaattcgaatgcatcgttagacttttctgttttcttatgattaaacaacaatggcttaaaatgatagcaagtcaactgaaaagttgctttggaataaaacaaaagtgggaatgccaactttcttttcttctctataacttcattaacatggttgtatagacatttgcatgtaaaatgtagctaacaaaaattacacagaagtaaatttagtcctctagtgcctacctctatggtgaaatcagaccatttggcatagtttgaagtcttccaagaagcctggtttccacctggaaaataaattactaaatttgaatgtgttacttatactatggtgagttgtctatctgttacattttattttagtgcatatactagaaattgtatttagggtgttctaaaattgtcatctgtcaaggtagagaattataataatataattatactcagaaagcgttctgattttagattattttggcactgttacaaatatgatgaattttaaaaaaatgcagaatgtttattacaaattcatatgtttaattgtcaaattctgagattaatttagataagctataaccaaagtttattttctttgcatttattggtacatagttaatgcttatacacaggcttcagtgtaacacctatacactattacaatatttagctgtacttatttgctttatctttaaatggtactttgtcccaaaattttctgagcttgataaattattaaacatttatcaaatcaaaaaagcattc

SEQ ID NO: 290605 - DNA, 2470 bp, Homo sapiens
  misc_feature (1552)..(1552): n is a, c, g, or t
  misc_feature (1683)..(1683): n is a, c, g, or t
attctcactttccctttgcattctgttagaatggtcctgtgtctgaattccccttggaatttggatagatttaaaagtgataggaataagtagctggtctttctagcctccgcctccaggcgggtgaggaggtgacacctgagaattcctccctctcacccctgaccctgccggaaagcgaaactgagatgcgggcattgggccctgggaagcgtggggaaggggaaaggagaaagccaggttaactacgtcaggattaatgtgttccacttctgctgcctgagaaaatggagaaattaagtcctttccatggatcattccttctgtaaacagagatcacaaagcaagagcttcagcatcctcgtgaaaaagacattttgttctgggtgtcatcatctccttccactacagcttgcaattggaacaagcttcacatcctgggggtgctgcctatctctgtcttgatttctgtctgtctattcctcccattgacaggaatgtcgtttgtatcctccacgcagcagtttgcagaaatccagcaaggtttatggtttatgttgcccagcatgtataaacacaacgctctcaaatgctttttaaaaatctatgaatttgttagatgtcttcacatcctggtcctcctaccccaattctcaaacacaaagtactctgttgccctattatagtcctgcgatagttctggctaggattaggttgacggtctaagccccaagaaaggcctggcattttcatagcaggctttccccagtgctttgagtcttcctctctcactccctttttctttttccctcggaggagggggtgttgggggtgggaggtgattagtaaatgtttcaggtaatctgtgaattcttaatagtcatatttccgtggtggaagatctccctatttctctgatgtgacaggttacagaaaccttggtgttgggggttttacagatatttacaagttctaggagtttgaactttgggtcaagatgttgattccttttaatgtgcgagggtgaaggaggttttattttgctttattcttttggatattatgagatgagattgtatccagtcttggctgtaacctataccataaatgcagagctgcaaccattatttctgtctctttctccttttatcacctacacttctagagatattactttcagttttattgcaaatcatctgtgtctttagtttaaaccattatttttcatataccccaggcacatttcccttataatgagacaaattttagattattaatgttccacctaaaaggatactgtacacttttcattgccaatatgggctttgaagcttaaatatcaacatttttataggaaatttacccatgtcaaatttaaatatatttgcttatatttcttggaaaaaagattttggataactatcaattaagcagccaattccatttggggtgcagaaaattttgagccccttgataagaaggaacaaaatttttcctctaaataaccaactctggatcagaaaaactgaacttttctaaatatttattattnacaaaacttttttttgtctgattccactagaagcattctatgttgtgaacactataaagttatcctatgttgtgaacaccataaagttatgagggaaaaaatgtcaaatctaaattttatttagaagtaanatattgtttttctggacttgcaatccaattcgaatgcatcgttagacttttctgttttcttatgattaaacaacaatggcttaaaatgatagcaagtcaactgaaaagttgctttggaataaaacaaaagtgggaatgccaactttcttttcttctctataacttcattaacatggttgtatagacatttgcatgtaaaatgtagctaacaaaaattacacagaagtaaatttagtcctctagtgcctacctctatggtgaaatcagaccatttggcatagtttgaagtcttccaagaagcctggtttccacctggaaaataaattactaaatttgaatgtgttacttatactatggtgagttgtctatctgttacattttattttagtgcatatactagaaattgtatttagggtgttctaaaattgtcatctgtcaaggtagagaattataataatataattatactcagaaagcgttctgattttagattattttggcactgttacaaatatgatgaattttaaaaaaatgcagaatgtttattacaaattcatatgtttaattgtcaaattctgagattaatttagataagctataaccaaagtttattttctttgcatttattggtacatagttaatgcttatacacaggcttcagtgtaacacctatacactattacaatatttagctgtacttatttgctttatctttaaatggtactttgtcccaaaattttctgagcttgataaattattaaacatttatcaaatcaaaaaagcattc

SEQ ID NO: 290606 - DNA, 1127 bp, Homo sapiens
attctcactttccctttgcattctgttagaatggtcctgtgtctgaattccccttggaatttggatagatttaaaagtgataggaataagtagctggtctttctagcctccgcctccaggcgggtgaggaggtgacacctgagaattcctccctctcacccctgaccctgccggaaagcgaaactgagatgcgggcattgggccctgggaagcgtggggaaggggaaaggagaaagccaggttaactacgtcaggattaatgtgttccacttctgctgcctgagaaaatggagaaattaagtcctttccatggatcattccttctgtaaacagagatcacaaagcaagagcttcagcatcctcgtgaaaaagacattttgttctgggtgtcatcatctccttccactacagcttgcaattggaacaagcttcacatcctgggggtgctgcctatctctgtcttgatttctgtctgtctattcctcccattgacaggaatgtcgtttgtatcctccacgcagcagtttgcagaaatccagcaaggtttatggtttatgttgcccagcatgtataaacacaacgctctcaaatgctttttaaaaatctatgaatttgttagatgtcttcacatcctggtcctcctaccccaattctcaaacacaaagtactctgttgccctattatagtcctgcgatagttctggctaggattaggttgacggtctaagccccaagaaaggcctggcattttcatagcaggctttccccagtgctttgagtcttcctctctcactccctttttctttttccctcggaggagggggtgttgggggtgggaggtgattagtaaatgtttcaggtaatctgtgaattcttaatagtcatatttccgtggtggaagatctccctatttctctgatgtgacaggttacagaaaccttggtgttgggggttttacagatatttacaagttctaggagtttgaactttgggtcaagatgttgattccttttaatgtgcgagggtgaaggaggttttattttgctttattcttttggatattatgagatgagattgtatccagtcttggctgtaacctataccataaatgcagagctgcaaccatta

SEQ ID NO: 290607 - DNA, 3002 bp, Homo sapiens
agagtgtcgcgggtgtgcttctgaggttagggtggaggactaattgaggaggctgggaagtctaactcgtgcagcggccctcggtgcagacagccgcgtaattcgggcatcagcctctttggcaagaaatagtgaggtcccctctcctccccactcttctcagctgctgcctccctcctacgggtgaattttctctcccgagaagggctgatttcctaggcttgctttccttccctcggcagcgctctgacgtgcacaccatgtgacaggcccccttctgctataagccgaggaaggtccgccctctcctggactcagccctggcctcgccgagctctgttcttagactctcacccgtcccgcacgttcctgggcgcctggcgttctgattcgcccgcccgggccccgccaccccctcctcagctgacggggcaaaagctgctccgagaggagaaggtcaagtcctccgcccgggccgggcgcgagcggagcccagggagcgcagcatccgcgcggctaccgcggcggcgcaggagttataaagtcggcgcgcgagactccgccgccacccggcagccccggcgcagctccggcagccgcagtcgcagcgcccccagcgtggcgccccccggccgggcctgccgcccgggacccgggctggggcgcagagggagcccggagcccggcgcccccatgcgccgccccgccgccgccgcgccacagctatgaccctgagcactgagatgtccgatgcctctggcctcgccgaggaaacagacatcgacgtggtgggggagggcgaggacgaagaagacgaggaagaggaggacgacgacgagggcggcggtggcgggccccggctggctgtccccgcgcagcggcggcggcggcggcgctcgtacgccggggaggacgagctggaggatctggaggaggaggaggacgacgatgacatcctgctggccccgcctgctgggggctccccggcgcccccgggcccggccccggcggcgggggcaggagccggtgggggcggcggcggcggcggcgcgggcggcggcgggagcgcgggtagcggcgccaagaacccgctggtgaagccgccctactcgtatatcgcgctcatcactatggccatcctgcagagccccaagaagcggctgacgctgagcgagatctgtgagttcatcagcggccgcttcccctactaccgggagaagttccccgcctggcagaacagcatccgccacaacctctcgctcaacgactgcttcgtcaagatcccccgcgagcccggcaacccgggcaagggcaactactggacgctggacccggagtccgccgacatgttcgacaacggcagcttcctgcgccggaggaagcgcttcaagcggcagccgctgctcccacccaacgccgcggccgccgagtctctgctgctgcgcggcgcgggagccgcagggggcgcgggcgacccggcagccgccgccgcgctcttcccgcccgcgcccccgccgcccccgcatgcctacggctacggcccctacggctgcggctacggcctgcagctgccgccttacgcgccgccctcggccctcttcgccgccgcagcggccgccgccgccgccgccgccttccacccgcactcgcccccgccgcccccgccaccgcacggcgcggccgccgagctggcccggaccgccttcggctaccggccgcacccgctcggcgccgccctacccggccccctgccggcctccgcggccaaggcgggcggcccgggcgcctcagcgctggcgcgctcgcccttctccatcgagagcatcatcgggggcagcttgggcccggccgccgctgccgccgccgccgcgcaggccgccgccgccgctcaggcctcgccctcgccctcgccggtggcggcgccgccagctcccggatccagcggaggaggctgcgcggcgcaggcggccgtgggcccggcggccgcgctcacccgatccctcgtggccgccgcggccgccgccgcctcctcagtctcctcgtccgccgccttggggactctgcaccaagggactgccctgtccagtgtcgagaactttactgctaggatttccaattgttaataacgctatgttagcgcgctcgaggaagaaggtaggaatcccggctccttttctcgtcttggtggttcggtgttttgttcgctcctccaggcgcggcccctctcgacctcgcgcgcccattttcgccgctgcgaattctcggacaaaactgtcaacagcccgggcgcgccttttggctctgcgggtccctctatttatgcaaagccgacctatgctacagccccccaacccccgacctggggtagggaggaagagggtgccggggaagggagtccgccctgtccaggcactagaggctcccttgacgtttggcagatgaaaaacaactaagcctttttgaggtgtagagattctcaggtccaggcgttaaaaaataatggtcaaaagaataatacaaaaatagtaaaggtcttgaagaatgccagcgaagcaattcttttttatttgaggacacttgtctggtgtactttttcatgaaaaggaaaaatggttaacatgtttacacaagaaaaaaagtcaaaattatcatttatttcaacctgtgttttgtatcataacagacgtgtggatttttttgtacttactgcgtattctttacaaggagtattgtaaattttactggcaattattattgtactattctaaatgtaagatttttacactttttcagaaataaaaatgcttaattttcaaagaaaattcaccaaaaaaagaaaaaaaaaaaaatttggggccgggccgaaaagttttaacccctttggggggggccgatgtaataaagctcttctccagaaacggccgacagggggttcccaaaaagcggggccggctgacacccgggtggcttgttcacgctctcctcccgtgccggggggggcg

SEQ ID NO: 290608 - DNA, 2786 bp, Homo sapiens
agagtgtcgcgggtgtgcttctgaggttagggtggaggactaattgaggaggctgggaagtctaactcgtgcagcggccctcggtgcagacagccgcgtaattcgggcatcagcctctttggcaagaaatagtgaggtcccctctcctccccactcttctcagctgctgcctccctcctacgggtgaattttctctcccgagaagggctgatttcctaggcttgctttccttccctcggcagcgctctgacgtgcacaccatgtgacaggcccccttctgctataagccgaggaaggtccgccctctcctggactcagccctggcctcgccgagctctgttcttagactctcacccgtcccgcacgttcctgggcgcctggcgttctgattcgcccgcccgggccccgccaccccctcctcagctgacggggcaaaagctgctccgagaggagaaggtcaagtcctccgcccgggccgggcgcgagcggagcccagggagcgcagcatccgcgcggctaccgcggcggcgcaggagttataaagtcggcgcgcgagactccgccgccacccggcagccccggcgcagctccggcagccgcagtcgcagcgcccccagcgtggcgccccccggccgggcctgccgcccgggacccgggctggggcgcagagggagcccggagcccggcgcccccatgcgccgccccgccgccgccgcgccacagctatgaccctgagcactgagatgtccgatgcctctggcctcgccgaggaaacagacatcgacgtggtgggggagggcgaggacgaagaagacgaggaagaggaggacgacgacgagggcggcgggagcgcgggtagcggcgccaagaacccgctggtgaagccgccctactcgtatatcgcgctcatcactatggccatcctgcagagccccaagaagcggctgacgctgagcgagatctgtgagttcatcagcggccgcttcccctactaccgggagaagttccccgcctggcagaacagcatccgccacaacctctcgctcaacgactgcttcgtcaagatcccccgcgagcccggcaacccgggcaagggcaactactggacgctggacccggagtccgccgacatgttcgacaacggcagcttcctgcgccggaggaagcgcttcaagcggcagccgctgctcccacccaacgccgcggccgccgagtctctgctgctgcgcggcgcgggagccgcagggggcgcgggcgacccggcagccgccgccgcgctcttcccgcccgcgcccccgccgcccccgcatgcctacggctacggcccctacggctgcggctacggcctgcagctgccgccttacgcgccgccctcggccctcttcgccgccgcagcggccgccgccgccgccgccgccttccacccgcactcgcccccgccgcccccgccaccgcacggcgcggccgccgagctggcccggaccgccttcggctaccggccgcacccgctcggcgccgccctacccggccccctgccggcctccgcggccaaggcgggcggcccgggcgcctcagcgctggcgcgctcgcccttctccatcgagagcatcatcgggggcagcttgggcccggccgccgctgccgccgccgccgcgcaggccgccgccgccgctcaggcctcgccctcgccctcgccggtggcggcgccgccagctcccggatccagcggaggaggctgcgcggcgcaggcggccgtgggcccggcggccgcgctcacccgatccctcgtggccgccgcggccgccgccgcctcctcagtctcctcgtccgccgccttggggactctgcaccaagggactgccctgtccagtgtcgagaactttactgctaggatttccaattgttaataacgctatgttagcgcgctcgaggaagaaggtaggaatcccggctccttttctcgtcttggtggttcggtgttttgttcgctcctccaggcgcggcccctctcgacctcgcgcgcccattttcgccgctgcgaattctcggacaaaactgtcaacagcccgggcgcgccttttggctctgcgggtccctctatttatgcaaagccgacctatgctacagccccccaacccccgacctggggtagggaggaagagggtgccggggaagggagtccgccctgtccaggcactagaggctcccttgacgtttggcagatgaaaaacaactaagcctttttgaggtgtagagattctcaggtccaggcgttaaaaaataatggtcaaaagaataatacaaaaatagtaaaggtcttgaagaatgccagcgaagcaattcttttttatttgaggacacttgtctggtgtactttttcatgaaaaggaaaaatggttaacatgtttacacaagaaaaaaagtcaaaattatcatttatttcaacctgtgttttgtatcataacagacgtgtggatttttttgtacttactgcgtattctttacaaggagtattgtaaattttactggcaattattattgtactattctaaatgtaagatttttacactttttcagaaataaaaatgcttaattttcaaagaaaattcaccaaaaaaagaaaaaaaaaaaaatttggggccgggccgaaaagttttaacccctttggggggggccgatgtaataaagctcttctccagaaacggccgacagggggttcccaaaaagcggggccggctgacacccgggtggcttgttcacgctctcctcccgtgccggggggggcg

SEQ ID NO: 290609 - DNA, 2082 bp, Homo sapiens
agagtgtcgcgggtgtgcttctgaggttagggtggaggactaattgaggaggctgggaagtctaactcgtgcagcggccctcggtgcagacagccgcgtaattcgggcatcagcctctttggcaagaaatagtgaggtcccctctcctccccactcttctcagctgctgcctccctcctacgggtgaattttctctcccgagaagggctgatttcctaggcttgctttccttccctcggcagcgctctgacgtgcacaccatgtgacaggcccccttctgctataagccgaggaaggtccgccctctcctggactcagccctggcctcgccgagctctgttcttagactctcacccgtcccgcacgttcctgggcgcctggcgttctgattcgcccgcccgggccccgccaccccctcctcagctgacggggcaaaagctgctccgagaggagaaggtcaagtcctccgcccgggccgggcgcgagcggagcccagggagcgcagcatccgcgcggctaccgcggcggcgcaggagttataaagtcggcgcgcgagactccgccgccacccggcagccccggcgcagctccggcagccgcagtcgcagcgcccccagcgtggcgccccccggccgggcctgccgcccgggacccgggctggggcgcagagggagcccggagcccggcgcccccatgcgccgccccgccgccgccgcgccacagctatgaccctgagcactgagatgtccgatgcctctggcctcgccgaggaaacagacatcgacgtggtgggggagggcgaggacgaagaagacgaggaagaggaggacgacgacgagggcggcgggagcgcgggtagcggcgccaagaacccgctggtgaagccgccctactcgtatatcgcgctcatcactatggccatcctgcagagccccaagaagcggctgacgctgagcgagatctgtgagttcatcagcggccgcttcccctactaccgggagaagttccccgcctggcagaacagcatccgccacaacctctcgctcaacgactgcttcgtcaagatcccccgcgagcccggcaacccgggcaagggcaactactggacgctggacccggaggtccgccgccttggggactctgcaccaagggactgccctgtccagtgtcgagaactttactgctaggatttccaattgttaataacgctatgttagcgcgctcgaggaagaaggtaggaatcccggctccttttctcgtcttggtggttcggtgttttgttcgctcctccaggcgcggcccctctcgacctcgcgcgcccattttcgccgctgcgaattctcggacaaaactgtcaacagcccgggcgcgccttttggctctgcgggtccctctatttatgcaaagccgacctatgctacagccccccaacccccgacctggggtagggaggaagagggtgccggggaagggagtccgccctgtccaggcactagaggctcccttgacgtttggcagatgaaaaacaactaagcctttttgaggtgtagagattctcaggtccaggcgttaaaaaataatggtcaaaagaataatacaaaaatagtaaaggtcttgaagaatgccagcgaagcaattcttttttatttgaggacacttgtctggtgtactttttcatgaaaaggaaaaatggttaacatgtttacacaagaaaaaaagtcaaaattatcatttatttcaacctgtgttttgtatcataacagacgtgtggatttttttgtacttactgcgtattctttacaaggagtattgtaaattttactggcaattattattgtactattctaaatgtaagatttttacactttttcagaaataaaaatgcttaattttcaaagaaaattcaccaaaaaaagaaaaaaaaaaaaatttggggccgggccgaaaagttttaacccctttggggggggccgatgtaataaagctcttctccagaaacggccgacagggggttcccaaaaagcggggccggctgacacccgggtggcttgttcacgctctcctcccgtgccggggggggcg

SEQ ID NO: 290610 - DNA, 794 bp, Homo sapiens
aaatggtggatccccctggattgcaggaatagggcaaaaaacccatggaattctcggacaaaactgtcaacagcccgggcgcgccttttggctctgcgggtccctctatttatgcaaagccgacctatgctacagccccccaacccccgacctggggtagggaggaagagggtgccggggaagggagtccgccctgtccaggcactagaggctcccttgacgtttggcagatgaaaaacaactaagcctttttgaggtgtagagattctcaggtccaggcgttaaaaaataatggtcaaaagaataatacaaaaatagtaaaggtcttgaagaatgccagcgaagcaattcttttttatttgaggacacttgtctggtgtactttttcatgaaaaggaaaaatggttaacatgtttacacaagaaaaaaagtcaaaattatcatttatttcaacctgtgttttgtatcataacagacgtgtggatttttttgtacttactgcgtattctttacaaggagtattgtaaattttactggcaattattattgtactattctaaatgtaagatttttacactttttcagaaataaaaatgcttaattttcaaagaaaattcaccaaaaaaagaaaaaaaaaaaaatttggggccgggccgaaaagttttaacccctttggggggggccgatgtaataaagctcttctccagaaacggccgacagggggttcccaaaaagcggggccggctgacacccgggtggcttgttcacgctctcctcccgtgccggggggggcg

SEQ ID NO: 290611 - DNA, 2985 bp, Homo sapiens
agagtgtcgcgggtgtgcttctgaggttagggtggaggactaattgaggaggctgggaagtctaactcgtgcagcggccctcggtgcagacagccgcgtaattcgggcatcagcctctttggcaagaaatagtgaggtcccctctcctccccactcttctcagctgctgcctccctcctacgggtgaattttctctcccgagaagggctgatttcctaggcttgctttccttccctcggcagcgctctgacgtgcacaccatgtgacaggcccccttctgctataagccgaggaaggtccgccctctcctggactcagccctggcctcgccgagctctgttcttagactctcacccgtcccgcacgttcctgggcgcctggcgttctgattcgcccgcccgggccccgccaccccctcctcagctgacggggcaaaagctgctccgagaggagaaggtcaagtcctccgcccgggccgggcgcgagcggagcccagggagcgcagcatccgcgcggctaccgcggcggcgcaggagttataaagtcggcgcgcgagactccgccgccacccggcagccccggcgcagctccggcagccgcagtcgcagcgcccccagcgtggcgccccccggccgggcctgccgcccgggacccgggctggggcgcagagggagcccggagcccggcgcccccatgcgccgccccgccgccgccgcgccacagctatgaccctgagcactgagatgtccgatgcctctggcctcgccgaggaaacagacatcgacgtggtgggggagggcgaggacgaagaagacgaggaagaggaggacgacgacgagggcggcggtggcgggccccggctggctgtccccgcgcagcggcggcggcggcggcgctcgtacgccggggaggacgagctggaggatctggaggaggaggaggacgacgatgacatcctgctggccccgcctgctgggggctccccggcgcccccgggcccggccccggcggcgggggcaggagccggtgggggcggcggcggcggcggcgcgggcggcggcgggagcgcgggtagcggcgccaagaacccgctggtgaagccgccctactcgtatatcgcgctcatcactatggccatcctgcagagccccaagaagcggctgacgctgagcgagatctgtgagttcatcagcggccgcttcccctactaccgggagaagttccccgcctggcagaacagcatccgccacaacctctcgctcaacgactgcttcgtcaagatcccccgcgagcccggcaacccgggcaagggcaactactggacgctggacccggagtccgccgacatgttcgacaacggcagcttcctgcgccggaggaagcgcttcaagcggcagccgctgctcccacccaacgccgcggccgccgagtctctgctgctgcgcggcgcgggagccgcagggggcgcgggcgacccggcagccgccgccgcgctcttcccgcccgcgcccccgccgcccccgcatgcctacggctacggcccctacggctgcggctacggcctgcagctgccgccttacgcgccgccctcggccctcttcgccgccgcagcggccgccgccgccgccgccgccttccacccgcactcgcccccgccgcccccgccaccgcacggcgcggccgccgagctggcccggaccgccttcggctaccggccgcacccgctcggcgccgccctacccggccccctgccggcctccgcggccaaggcgggcggcccgggcgcctcagcgctggcgcgctcgcccttctccatcgagagcatcatcgggggcagcttgggcccggccgccgctgccgccgccgccgcgcaggccgccgccgccgctcaggcctcgccctcgccctcgccggtggcggcgccgccagctcccggatccagcggaggaggctgcgcggcgcaggcggccgtgggcccggcggccgcgctcacccgatccctcgtggccgccgcggccgccgccgcctcctcagtctcctcgtccgccgccttggggactctgcaccaagggactgccctgtccagtgtcgagaactttactgctaggatttccaattgttaataacgctatgttagcgcgctcgaggaagaaggtaggaatcccggctccttttctcgtcttggtggttcggtgttttgttcgctcctccaggcgcggcccctctcgacctcgcgcgcccattttcgccgctgcgaattctcggacaaaactgtcaacagcccgggcgcgccttttggctctgcgggtccctctatttatgcaaagccgacctatgctacagccccccaacccccgacctggggtagggaggaagagggtgccggggaagggagtccgccctgtccaggcactagaggctcccttgacgtttggcagatgaaaaacaactaagcctttttgaggtgtagagattctcaggtccaggcgttaaaaaataatggtcaaaagaataatacaaaaatagtaaaggtcttgaagaatgccagcgaagcaattcttttttatttgaggacacttgtctggtgtactttttcatgaaaaggaaaaatggttaacatgtttacacaagaaaaaaagtcaaaattatcatttatttcaacctgtgttttgtatcataacagacgtgtggatttttttgtacttactgcgtattctttacaaggagtattgtaaattttactggcaattattattgtactattctaaatgtaagatttttacactttttcagaaataaatggttatttcaagaaatccaaaaaaaaaaaaaaagagaaaaaaaaaaaggggggtaaaaatacggggccattggcccgtttgaagggcaagaaggagaaaaaaggggggaaaggggaaaggggttggggctggggtgagcccaaaggaaagtggagtggttatataatagacgggaagagaaaga

SEQ ID NO: 290612 - DNA, 2192 bp, Homo sapiens
agagtgtcgcgggtgtgcttctgaggttagggtggaggactaattgaggaggctgggaagtctaactcgtgcagcggccctcggtgcagacagccgcgtaattcgggcatcagcctctttggcaagaaatagtgaggtcccctctcctccccactcttctcagctgctgcctccctcctacgggtgaattttctctcccgagaagggctgatttcctaggcttgctttccttccctcggcagcgctctgacgtgcacaccatgtgacaggcccccttctgctataagccgaggaaggtccgccctctcctggactcagccctggcctcgccgagctctgttcttagactctcacccgtcccgcacgttcctgggcgcctggcgttctgattcgcccgcccgggccccgccaccccctcctcagctgacggggcaaaagctgctccgagaggagaaggtcaagtcctccgcccgggccgggcgcgagcggagcccagggagcgcagcatccgcgcggctaccgcggcggcgcaggagttataaagtcggcgcgcgagactccgccgccacccggcagccccggcgcagctccggcagccgcagtcgcagcgcccccagcgtggcgccccccggccgggcctgccgcccgggacccgggctggggcgcagagggagcccggagcccggcgcccccatgcgccgccccgccgccgccgcgccacagctatgaccctgagcactgagatgtccgatgcctctggcctcgccgaggaaacagacatcgacgtggtgggggagggcgaggacgaagaagacgaggaagaggaggacgacgacgagggcggcgggagcgcgggtagcggcgccaagaacccgctggtgaagccgccctactcgtatatcgcgctcatcactatggccatcctgcagagccccaagaagcggctgacgctgagcgagatctgtgagttcatcagcggccgcttcccctactaccgggagaagttccccgcctggcagaacagcatccgccacaacctctcgctcaacgactgcttcgtcaagatcccccgcgagcccggcaacccgggcaagggcaactactggacgctggacccggagtccgccgacatgttcgacaacggcagcttcctgcgccggaggaagcgcttcaagcggcagccgctgctcccacccaacgccgcggccgccgccgcctcctcagtctcctcgtccgccgccttggggactctgcaccaagggactgccctgtccagtgtcgagaactttactgctaggatttccaattgttaataacgctatgttagcgcgctcgaggaagaaggtaggaatcccggctccttttctcgtcttggtggttcggtgttttgttcgctcctccaggcgcggcccctctcgacctcgcgcgcccattttcgccgctgcgaattctcggacaaaactgtcaacagcccgggcgcgccttttggctctgcgggtccctctatttatgcaaagccgacctatgctacagccccccaacccccgacctggggtagggaggaagagggtgccggggaagggagtccgccctgtccaggcactagaggctcccttgacgtttggcagatgaaaaacaactaagcctttttgaggtgtagagattctcaggtccaggcgttaaaaaataatggtcaaaagaataatacaaaaatagtaaaggtcttgaagaatgccagcgaagcaattcttttttatttgaggacacttgtctggtgtactttttcatgaaaaggaaaaatggttaacatgtttacacaagaaaaaaagtcaaaattatcatttatttcaacctgtgttttgtatcataacagacgtgtggatttttttgtacttactgcgtattctttacaaggagtattgtaaattttactggcaattattattgtactattctaaatgtaagatttttacactttttcagaaataaaaatgcttaattttcaaagaaaattcaccaaaaaaagaaaaaaaaaaaaatttggggccgggccgaaaagttttaacccctttggggggggccgatgtaataaagctcttctccagaaacggccgacagggggttcccaaaaagcggggccggctgacacccgggtggcttgttcacgctctcctcccgtgccggggggggcg

SEQ ID NO: 290613 - DNA, 2582 bp, Homo sapiens
agagtgtcgcgggtgtgcttctgaggttagggtggaggactaattgaggaggctgggaagtctaactcgtgcagcggccctcggtgcagacagccgcgtaattcgggcatcagcctctttggcaagaaatagtgaggtcccctctcctccccactcttctcagctgctgcctccctcctacgggtgaattttctctcccgagaagggctgatttcctaggcttgctttccttccctcggcagcgctctgacgtgcacaccatgtgacaggcccccttctgctataagccgaggaaggtccgccctctcctggactcagccctggcctcgccgagctctgttcttagactctcacccgtcccgcacgttcctgggcgcctggcgttctgattcgcccgcccgggccccgccaccccctcctcagctgacggggcaaaagctgctccgagaggagaaggtcaagtcctccgcccgggccgggcgcgagcggagcccagggagcgcagcatccgcgcggctaccgcggcggcgcaggagttataaagtcggcgcgcgagactccgccgccacccggcagccccggcgcagctccggcagccgcagtcgcagcgcccccagcgtggcgccccccggccgggcctgccgcccgggacccgggctggggcgcagagggagcccggagcccggcgcccccatgcgccgccccgccgccgccgcgccacagctatgaccctgagcactgagatgtccgatgcctctggcctcgccgaggaaacagacatcgacgtggtgggggagggcgaggacgaagaagacgaggaagaggaggacgacgacgagggcggcgggagcgcgggtagcggcgccaagaacccgctggtgaagccgccctactcgtatatcgcgctcatcactatggccatcctgcagagccccaagaagcggctgacgctgagcgagatctgtgagttcatcagcggccgcttcccctactaccgggagaagttccccgcctggcagaacagcatccgccacaacctctcgctcaacgactgcttcgtcaagatcccccgcgagcccggcaacccgggcaagggcaactactggacgctggacccggagtccgccgacatgttcgacaacggcagcttcctgcgccggaggaagcgcttcaagcggcagccgctgctcccacccaacgccgcggccgccgagtctctgctgctgcgcggcgcgggagccgcagggggcgcgggcgacccggcagccgccgccgcgctcttcccgcccgcgcccccgccgcccccgcatgcctacggctacggcccctacggctgcggctacggcctgcagctgccgccttacgcgccgccctcggccctcttcgccgccgcagcggccgccgccgccgccgccgccttccacccgcactcgcccccgccgcccccgccaccgcacggcgcggccgccgagctggcccggaccgccttcggctaccggccgcacccgctcggcgccgccctacccggccccctgccggcctccgcggccaaggcgggcggcccgggcgcctcagcgctggcgcgctcgcccttctccatcgagagcatcatcgggggcagcttgggcccggccgccgctgccgccgccgccgcgcaggccgccgccgccgctcaggcctcgccctcgccctcgccggtggcggcgccgccagctcccggatccagcggaggaggctgcgcggcgcaggcggccgtgggcccggcggccgcgctcacccgatccctcgtggccgccgcggccgccgccgcctcctcagtctcctcgtccgccgccttggggactctgcaccaagggactgccctgtccagtgtcgagaactttactgctaggatttccaattgttaataacgctatgctacagccccccaacccccgacctggggtagggaggaagagggtgccggggaagggagtccgccctgtccaggcactagaggctcccttgacgtttggcagatgaaaaacaactaagcctttttgaggtgtagagattctcaggtccaggcgttaaaaaataatggtcaaaagaataatacaaaaatagtaaaggtcttgaagaatgccagcgaagcaattcttttttatttgaggacacttgtctggtgtactttttcatgaaaaggaaaaatggttaacatgtttacacaagaaaaaaagtcaaaattatcatttatttcaacctgtgttttgtatcataacagacgtgtggatttttttgtacttactgcgtattctttacaaggagtattgtaaattttactggcaattattattgtactattctaaatgtaagatttttacactttttcagaaataaaaatgcttaattttcaaagaaaattcaccaaaaaaagaaaaaaaaaaaaatttggggccgggccgaaaagttttaacccctttggggggggccgatgtaataaagctcttctccagaaacggccgacagggggttcccaaaaagcggggccggctgacacccgggtggcttgttcacgctctcctcccgtgccggggggggcg

SEQ ID NO: 290614 - DNA, 225 bp, Homo sapiens
ctgaatttgcagctcggtaagtcatggactccatgttttatcattgaatgtatatatacgagataaaccatactatggaaagagagccgctgtttgcttcacagacagatgggtttgatttgggagtaatctagtgttttggattggctgtcactgctatcctcttcagcatgaccatctgaattataaactggtactcactgggcttcataggactatgggcat

SEQ ID NO: 290615 - DNA, 750 bp, Homo sapiens
gctaggggagcatcgggcaagggttcttcccatgactgtaaggtagtgatgtttcctcttcctccacagcccaggcttgcatccctccctgcggtctccaggagttcgcccggcgtttcctctgcagcgggtgctactctagggtctgcgacctcccgctggactgcccagttcaggatgtgacagtgactcggggcgaccaggctatgttttcttgcatcgtaaacttccagctgccaaaggaggagatcacctattcctggaagttcgcaggaggaggtctccggactcaggacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacgtgacgggcccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggatgttctttcgatggtactgcagtggcaactaacaaaggtatctttcctccttccctatcctatttccatcctgaaaataaagaatatatttcaactcta

SEQ ID NO: 290616 - DNA, 717 bp, Homo sapiens
cctcctccctcagatccaagagtccagacccccaagtttctcttccttcagacccaaaagcccaggccccctgccccctcctccctcagaaccaggagtccgggccctgtacacctttttgaccctggtgtccaggcctccgggacctaagtttctagtcaccaacccctcctgtaacacacatacctctttgtttccccaggatgttctttcgatggtactgcagtggcaactaacaaaggtatctttcctccttccctatcctatttccatcctgaaaataaagaatatatttcaactctagattgtttcatctccgaaggtggtcactactaactcaggtaggaggaggtgcagcaagcccacacatgcccagatgaatatggcccgcataatgacagtgataggcatagctatcccagtgcaagttaggtgggaacccagataccccctcaggttactggctgtctccttgacatttccatctgcagaaggcaccctcaaatagagtcctccatgttgccctcagaggctgttcctccccaaggctttcctcctaccagaaagagcaacaccatccacctagcagttcaaaccagaaaccttggaatctaacttctcctccacttccaattcattttcatttccaaccctcagactttttaactcctaaatatctcatgaagctgccttctctgtggtcccagtcacccccac

SEQ ID NO: 290617 - DNA, 303 bp, Homo sapiens
cctcctccctcagatccaagagtccagacccccaagtttctcttccttcagacccaaaagcccaggccccctgccccctcctccctcagaaccaggagtccgggccctgtacacctttttgaccctggtgtccaggcctccgggacctaagtttctagtcaccaacccctcctgtaacacacatacctctttgtttccccaggatgttctttcgatggtactgcagtggcaactaacaaaggtatctttcctccttccctatcctatttccatcctgaaaataaagaatatatttcaactcta

SEQ ID NO: 290618 - DNA, 400 bp, Homo sapiens
actagtaatattactagtgaattcactagtaatattactagtgaattcactagtaatgcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggtgagttctggggactccggagccccagcatctagctccccgctgtctcagatcccaccgagaagtctgggttcccagcaacctccaacccaggaggatgttctttcgatggtactgcagtggcaactaacaaaggtatctttcctccttccctatcctatttccatcctgaaaataaagaatatatttcaactcta

SEQ ID NO: 290619 - DNA, 1763 bp, Homo sapiens
gccagtgccgtcccgtctgccctgctggccctggctgtcttcagggtgcccgcctgggcctgtctcctctgcttcacaacctactctgagcgcctccgcatctgccagatgtttgttgggatgcggagccccaagcttgaagagtgtgaggaggccttcacggccgccttccagggcctctctgacaccgaaatcagtgaggagaccatccacacttcatcagtgtcctggggaaggtgcagagggagggcaggagaggcccagagggtcaggctgagggacagacagagagaaacagtcagaggagaaaggctcaaagaccatgagaacaacagagacttagggacagagagacacagacaggggaagacagcagggcaaagactcagagaggggaggatggagagtcagagaggggaagatggagactcagagagggggaggatggagactcagagagagaggaagatggagactcggaaagatggagactcaggagtatggagagtcagagaggggaggatggacactcaggggaggatggagagtcaggaggatggagactcatagaaaggggaggatggagagtcaggagaggttggagactggagagggaatagagacccagagaggggaggatggagactcagagggtggaagatggagactcaaagaggatggaaacccagagagaggaggacagagatgaggcagagactaggggaagcaggatagcgactggtcgggggcagagactcagggaggatagagacttgggagggactcaggaagcatagcgactgtggggcaaagagtcagagaggggaggatacagacttgggagggcagagactcagaaacagaatgttcgcattagggacatggtgtagcggggagctgcctcccccagcccctgctccctccctcaccgccagactatgatgagagaagccacctgcatgacaccttcacccagatgacccatgccctgcaggagctggctgctgcccagggatcctttgaggttgccttccctgatgctgcggagaaaatgaagaaggtcattacacagcttaaagaagcccaggcttgcatccctccctgcggtctccaggagttcgcccggcgtttcctctgcagcgggtgctactctagggtctgcgacctcccgctggactgcccagttcaggatgtgacagtgactcggggcgaccaggctatgttttcttgcatcgtaaacttccagctgccaaaggaggagatcacctattcctggaagttcgcaggaggaggtctccggactcaggacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacgtgacgggcccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggatgttctttcgatggtactgcagtggcaactaacaaaggtatctttcctccttccctatcctatttccatcctgaaaataaagaatatatttcaactcta

SEQ ID NO: 290620 - DNA, 813 bp, Homo sapiens
gagaggagtgagagtcggccaaagacagcagggagggcggggtcaagatgccacctggccgatggaccccgggaagctgcatggatctcaaatgggccaagggccccgggcttggaagggcaggtggcgcctagacccagcgttcccgctccacaggtctccaggagttcgcccggcgtttcctctgcagcgggtgctactctagggtctgcgacctcccgctggactgcccagttcaggatgtgacagtgactcggggcgaccaggctatgttttcttgcatcgtaaacttccagctgccaaaggaggagatcacctattcctggaagttcgcaggaggaggtctccggactcaggacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacgtgacgggcccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggatgttctttcgatggtactgcagtggcaactaacaaaggtatctttcctccttccctatcctatttccatcctgaaaataaagaatatatttcaactcta

SEQ ID NO: 290621 - DNA, 1846 bp, Homo sapiens
gccagtgccgtcccgtctgccctgctggccctggctgtcttcagggtgcccgcctgggcctgtctcctctgcttcacaacctactctgagcgcctccgcatctgccagatgtttgttgggatgcggagccccaagcttgaagagtgtgaggaggccttcacggccgccttccagggcctctctgacaccgaaatcagtgaggagaccatccacacttcatcagtgtcctggggaaggtgcagagggagggcaggagaggcccagagggtcaggctgagggacagacagagagaaacagtcagaggagaaaggctcaaagaccatgagaacaacagagacttagggacagagagacacagacaggggaagacagcagggcaaagactcagagaggggaggatggagagtcagagaggggaagatggagactcagagagggggaggatggagactcagagagagaggaagatggagactcggaaagatggagactcaggagtatggagagtcagagaggggaggatggacactcaggggaggatggagagtcaggaggatggagactcatagaaaggggaggatggagagtcaggagaggttggagactggagagggaatagagacccagagaggggaggatggagactcagagggtggaagatggagactcaaagaggatggaaacccagagagaggaggacagagatgaggcagagactaggggaagcaggatagcgactggtcgggggcagagactcagggaggatagagacttgggagggactcaggaagcatagcgactgtggggcaaagagtcagagaggggaggatacagacttgggagggcagagactcagaaacagaatgttcgcattagggacatggtgtagcggggagctgcctcccccagcccctgctccctccctcaccgccagactatgatgagagaagccacctgcatgacaccttcacccagatgacccatgccctgcaggagctggctgctgcccagggatcctttgaggttgccttccctgatgctgcggagaaaatgaagaaggtcattacacagcttaaagaagcccaggcttgcatccctccctgcggtctccaggagttcgcccggcgtttcctctgcagcgggtgctactctagggtctgcgacctcccgctggactgcccagttcaggatgtgacagtgactcggggcgaccaggctatgttttcttgcatcgtaaacttccagctgccaaaggaggagatcacctattcctggaagttcgcaggaggaggtctccggactcaggacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacggtggggcggggcgcggccgcgtgagtgagcggggtcgggagaggggtggggctcgtgcctggctgacgtgcgcgcccccgcagtgacgggcccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggatgttctttcgatggtactgcagtggcaactaacaaaggtatctttcctccttccctatcctatttccatcctgaaaataaagaatatatttcaactcta

SEQ ID NO: 290622 - DNA, 896 bp, Homo sapiens
gagaggagtgagagtcggccaaagacagcagggagggcggggtcaagatgccacctggccgatggaccccgggaagctgcatggatctcaaatgggccaagggccccgggcttggaagggcaggtggcgcctagacccagcgttcccgctccacaggtctccaggagttcgcccggcgtttcctctgcagcgggtgctactctagggtctgcgacctcccgctggactgcccagttcaggatgtgacagtgactcggggcgaccaggctatgttttcttgcatcgtaaacttccagctgccaaaggaggagatcacctattcctggaagttcgcaggaggaggtctccggactcaggacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacggtggggcggggcgcggccgcgtgagtgagcggggtcgggagaggggtggggctcgtgcctggctgacgtgcgcgcccccgcagtgacgggcccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggatgttctttcgatggtactgcagtggcaactaacaaaggtatctttcctccttccctatcctatttccatcctgaaaataaagaatatatttcaactcta

SEQ ID NO: 290623 - DNA, 2260 bp, Homo sapiens
gccagtgccgtcccgtctgccctgctggccctggctgtcttcagggtgcccgcctgggcctgtctcctctgcttcacaacctactctgagcgcctccgcatctgccagatgtttgttgggatgcggagccccaagcttgaagagtgtgaggaggccttcacggccgccttccagggcctctctgacaccgaaatcagtgaggagaccatccacacttcatcagtgtcctggggaaggtgcagagggagggcaggagaggcccagagggtcaggctgagggacagacagagagaaacagtcagaggagaaaggctcaaagaccatgagaacaacagagacttagggacagagagacacagacaggggaagacagcagggcaaagactcagagaggggaggatggagagtcagagaggggaagatggagactcagagagggggaggatggagactcagagagagaggaagatggagactcggaaagatggagactcaggagtatggagagtcagagaggggaggatggacactcaggggaggatggagagtcaggaggatggagactcatagaaaggggaggatggagagtcaggagaggttggagactggagagggaatagagacccagagaggggaggatggagactcagagggtggaagatggagactcaaagaggatggaaacccagagagaggaggacagagatgaggcagagactaggggaagcaggatagcgactggtcgggggcagagactcagggaggatagagacttgggagggactcaggaagcatagcgactgtggggcaaagagtcagagaggggaggatacagacttgggagggcagagactcagaaacagaatgttcgcattagggacatggtgtagcggggagctgcctcccccagcccctgctccctccctcaccgccagactatgatgagagaagccacctgcatgacaccttcacccagatgacccatgccctgcaggagctggctgctgcccagggatcctttgaggttgccttccctgatgctgcggagaaaatgaagaaggtcattacacagcttaaagaagcccaggcttgcatccctccctgcggtctccaggagttcgcccggcgtttcctctgcagcgggtgctactctagggtctgcgacctcccgctggactgcccagttcaggatgtgacagtgactcggggcgaccaggctatgttttcttgcatcgtaaacttccagctgccaaaggaggagatcacctattcctggaagttcgcaggaggaggtctccggactcaggacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacggtggggcggggcgcggccgcgtgagtgagcggggtcgggagaggggtggggctcgtgcctggctgacgtgcgcgcccccgcagtgacgggcccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggatgttctttcgatggtactgcagtggcaactaacaaaggtatctttcctccttccctatcctatttccatcctgaaaataaagaatatatttcaactctagattgtttcatctccgaaggtggtcactactaactcaggtaggaggaggtgcagcaagcccacacatgcccagatgaatatggcccgcataatgacagtgataggcatagctatcccagtgcaagttaggtgggaacccagataccccctcaggttactggctgtctccttgacatttccatctgcagaaggcaccctcaaatagagtcctccatgttgccctcagaggctgttcctccccaaggctttcctcctaccagaaagagcaacaccatccacctagcagttcaaaccagaaaccttggaatctaacttctcctccacttccaattcattttcatttccaaccctcagactttttaactcctaaatatctcatgaagctgccttctctgtggtcccagtcacccccac

SEQ ID NO: 290624 - DNA, 2177 bp, Homo sapiens
gccagtgccgtcccgtctgccctgctggccctggctgtcttcagggtgcccgcctgggcctgtctcctctgcttcacaacctactctgagcgcctccgcatctgccagatgtttgttgggatgcggagccccaagcttgaagagtgtgaggaggccttcacggccgccttccagggcctctctgacaccgaaatcagtgaggagaccatccacacttcatcagtgtcctggggaaggtgcagagggagggcaggagaggcccagagggtcaggctgagggacagacagagagaaacagtcagaggagaaaggctcaaagaccatgagaacaacagagacttagggacagagagacacagacaggggaagacagcagggcaaagactcagagaggggaggatggagagtcagagaggggaagatggagactcagagagggggaggatggagactcagagagagaggaagatggagactcggaaagatggagactcaggagtatggagagtcagagaggggaggatggacactcaggggaggatggagagtcaggaggatggagactcatagaaaggggaggatggagagtcaggagaggttggagactggagagggaatagagacccagagaggggaggatggagactcagagggtggaagatggagactcaaagaggatggaaacccagagagaggaggacagagatgaggcagagactaggggaagcaggatagcgactggtcgggggcagagactcagggaggatagagacttgggagggactcaggaagcatagcgactgtggggcaaagagtcagagaggggaggatacagacttgggagggcagagactcagaaacagaatgttcgcattagggacatggtgtagcggggagctgcctcccccagcccctgctccctccctcaccgccagactatgatgagagaagccacctgcatgacaccttcacccagatgacccatgccctgcaggagctggctgctgcccagggatcctttgaggttgccttccctgatgctgcggagaaaatgaagaaggtcattacacagcttaaagaagcccaggcttgcatccctccctgcggtctccaggagttcgcccggcgtttcctctgcagcgggtgctactctagggtctgcgacctcccgctggactgcccagttcaggatgtgacagtgactcggggcgaccaggctatgttttcttgcatcgtaaacttccagctgccaaaggaggagatcacctattcctggaagttcgcaggaggaggtctccggactcaggacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacgtgacgggcccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggatgttctttcgatggtactgcagtggcaactaacaaaggtatctttcctccttccctatcctatttccatcctgaaaataaagaatatatttcaactctagattgtttcatctccgaaggtggtcactactaactcaggtaggaggaggtgcagcaagcccacacatgcccagatgaatatggcccgcataatgacagtgataggcatagctatcccagtgcaagttaggtgggaacccagataccccctcaggttactggctgtctccttgacatttccatctgcagaaggcaccctcaaatagagtcctccatgttgccctcagaggctgttcctccccaaggctttcctcctaccagaaagagcaacaccatccacctagcagttcaaaccagaaaccttggaatctaacttctcctccacttccaattcattttcatttccaaccctcagactttttaactcctaaatatctcatgaagctgccttctctgtggtcccagtcacccccac

SEQ ID NO: 290625 - DNA, 202 bp, Homo sapiens
tccagggggcgtggtctggctcggggggcggggcttgtaggttactcagtggcaagccggagttgaggcgtttaaacccgcgtgtcccgcagctccggactcaggacttgtcctatttccgagatatgccgcgggccgaaggatacctggcgcggatccggccggctcagctcacgcaccgcgggacgttctcctgcgtgat

SEQ ID NO: 290626 - DNA, 2944 bp, Homo sapiens
cagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtactatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgtctagagagcctagtgctgacctatatcaatgctatcagcagaggggatctgccctgcatggagaacgcagtcctggccttggcccagatagagaactcagccgcagtgcaaaaggctattgcccactatgaccagcagatgggccagaaggtgcagctgcccgcagaaaccctccaggagctgctggacctgcacagggttagtgagagggaggccactgaagtctatatgaagaactctttcaaggatgtggaccatctgtttcaaaagaaattagcggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacctggagaaaaagtactatgaggaaccaaggaaggggatacaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccaccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatattttccataggaaggtaaagaaatcattagcaagagtaggaattgaatcataaacaaattggctaatgaagaaatcttttctttcttgttcaattcatctagattataaccttaatgtgacacctgagacctttagacagttgaccctgaattaaatagtcacatggtaacaattatgcactgtgtaattttagtaatgtataacatgcaatgatgcactttaactgaagatagagactatgttagaaaattgaactaatttaattatttgattgttttaatcctaaagcataagttagtcttttcctgattcttaaaggtcatacttgaaatcctgccaattttccccaaagggaatatggaatttttttgactttcttttgagcaataaaataattgtcttgccattacttagtatatgtagacttcatcccaattgtcaaacatcctaggtaagtggttgacatttcttacagcaattacagattatttttgaactagaaataaactaaactagaaataaaataagtttcactagtt

SEQ ID NO: 290627 - DNA, 3189 bp, Homo sapiens
cagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtagtatccttttgtgacccagaacagcaccaaggtcagaggggacacctgtattcataaaccagctgcctgactgtgaatcctgatgaatcaagctcaaaaggagaaaacaaaaaataatgcaagtacagaggagagatcccatctatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgtctagagagcctagtgctgacctatatcaatgctatcagcagaggggatctgccctgcatggagaacgcagtcctggccttggcccagatagagaactcagccgcagtgcaaaaggctattgcccactatgaccagcagatgggccagaaggtgcagctgcccgcagaaaccctccaggagctgctggacctgcacagggttagtgagagggaggccactgaagtctatatgaagaactctttcaaggatgtggaccatctgtttcaaaagaaattagcggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacctggagaaaaagtactatgaggaaccaaggaaggggatacaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccaccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatattttccataggaaggtaaagaaatcattagcaagagtaggaattgaatcataaacaaattggctaatgaagaaatcttttctttcttgttcaattcatctagattataaccttaatgtgacacctgagacctttagacagttgaccctgaattaaatagtcacatggtaacaattatgcactgtgtaattttagtaatgtataacatgcaatgatgcactttaactgaagatagagactatgttagaaaattgaactaatttaattatttgattgttttaatcctaaagcataagttagtcttttcctgattcttaaaggtcatacttgaaatcctgccaattttccccaaagggaatatggaatttttttgactttcttttgagcaataaaataattgtcttgccattacttagtatatgtagacttcatcccaattgtcaaacatcctaggtaagtggttgacatttcttacagcaattacagattatttttgaactagaaataaactaaactagaaataaaataagtttcactagtt

SEQ ID NO: 290628 - DNA, 3056 bp, Homo sapiens
cagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtagtatccttttgtgacccagaacagcaccaaggtcagaggggacacctgtattcataaaccagctgcctgactgtgaatcctgatgaatcaagctcaaaaggagaaaacaaaaaataatgcaagtacagaggagagatcccatctatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgtctagagagcctagtgctgacctatatcaatgctatcagcagaggggatctgccctgcatggagaacgcagtcctggccttggcccagatagagaactcagccgcagtgcaaaaggctattgcccactatgaccagcagatgggccagaaggtgcagctgcccgcagaaaccctccaggagctgctggacctgcacagggttagtgagagggaggccactgaagtctatatgaagaactctttcaaggatgtggaccatctgtttcaaaagaaattagcggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacctggagaaaaagtactatgaggaaccaaggaaggggatacaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccaccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatattttccataggaaggtaaagaaatcattagcaagagtaggaattgaatcataaacaaattggctaatgaagaaatcttttctttcttgttcaattcatctagattataaccttaatgtgacacctgagacctttagacagttgaccctgaattaaatagtcacatggtaacaattatgcactgtgtaattttagtaatgtataacatgcaatgatgcactttaactgaagatagagactatgttagaaaattgaactaatttaattatttgattgttttaatcctaaagcataagttagtcttttcctgattcttaaaggtcatacttgaaatcctgccaattttccccaaagggaatatggaatttttttgactttcttttgagcaataaaataattgtcttgcca

SEQ ID NO: 290629 - DNA, 3047 bp, Homo sapiens
cagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtactatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgtctagagagcctagtgctgacctatatcaatgctatcagcagaggggatctgccctgcatggagaacgcagtcctggccttggcccagatagagaactcagccgcagtgcaaaaggctattgcccactatgaccagcagatgggccagaaggtgcagctgcccgcagaaaccctccaggagctgctggacctgcacagggttagtgagagggaggccactgaagtctatatgaagaactctttcaaggatgtggaccatctgtttcaaaagaaattagcggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacctggagaaaaagtactatgaggaaccaaggaaggggatacaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccaccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatattttccataggaaggtaaagaaatcattagcaagagtaggaattgaatcataaacaaattggctaatgaagaaatcttttctttcttgttcaattcatctagattataaccttaatgtgacacctgagacctttagacagttgaccctgaattaaatagtcacatggtaacaattatgcactgtgtaattttagtaatgtataacatgcaatgatgcactttaactgaagatagagactatgttagaaaattgaactaatttaattatttgattgttttaatcctaaagcataagttagtcttttcctgattcttaaaggtcatacttgaaatcctgccaattttccccaaagggaatatggaatttttttgactttcttttgagcaataaaataattgtcttgccattacttagtatatgtagacttcatcccaattgtcaaacatcctaggtaagtggttgacatttcttacagcaattacagattatttttgaactagaaataaactaaactagaaataaaataagtttcactagtt

SEQ ID NO: 290630 - DNA, 3133 bp, Homo sapiens
cagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggctggagtacagtggcaagatctcagctcaccacagtcttgacttcctgggctcaagcaatcctctcacctcagcctcctgagtaggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtactatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgtctagagagcctagtgctgacctatatcaatgctatcagcagaggggatctgccctgcatggagaacgcagtcctggccttggcccagatagagaactcagccgcagtgcaaaaggctattgcccactatgaccagcagatgggccagaaggtgcagctgcccgcagaaaccctccaggagctgctggacctgcacagggttagtgagagggaggccactgaagtctatatgaagaactctttcaaggatgtggaccatctgtttcaaaagaaattagcggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacctggagaaaaagtactatgaggaaccaaggaaggggatacaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccaccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatattttccataggaaggtaaagaaatcattagcaagagtaggaattgaatcataaacaaattggctaatgaagaaatcttttctttcttgttcaattcatctagattataaccttaatgtgacacctgagacctttagacagttgaccctgaattaaatagtcacatggtaacaattatgcactgtgtaattttagtaatgtataacatgcaatgatgcactttaactgaagatagagactatgttagaaaattgaactaatttaattatttgattgttttaatcctaaagcataagttagtcttttcctgattcttaaaggtcatacttgaaatcctgccaattttccccaaagggaatatggaatttttttgactttcttttgagcaataaaataattgtcttgccattacttagtatatgtagacttcatcccaattgtcaaacatcctaggtaagtggttgacatttcttacagcaattacagattatttttgaactagaaataaactaaactagaaataaaataagtttcactagtt

SEQ ID NO: 290631 - DNA, 2553 bp, Homo sapiens
cagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtactatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccaccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatattttccataggaaggtaaagaaatcattagcaagagtaggaattgaatcataaacaaattggctaatgaagaaatcttttctttcttgttcaattcatctagattataaccttaatgtgacacctgagacctttagacagttgaccctgaattaaatagtcacatggtaacaattatgcactgtgtaattttagtaatgtataacatgcaatgatgcactttaactgaagatagagactatgttagaaaattgaactaatttaattatttgattgttttaatcctaaagcataagttagtcttttcctgattcttaaaggtcatacttgaaatcctgccaattttccccaaagggaatatggaatttttttgactttcttttgagcaataaaataattgtcttgccattacttagtatatgtagacttcatcccaattgtcaaacatcctaggtaagtggttgacatttcttacagcaattacagattatttttgaactagaaataaactaaactagaaataaaataagtttcactagtt

SEQ ID NO: 290632 - DNA, 3001 bp, Homo sapiens
cagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtactatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgtctagagagcctagtgctgacctatatcaatgctatcagcagaggggatctgccctgcatggagaacgcagtcctggccttggcccagatagagaactcagccgcagtgcaaaaggctattgcccactatgaccagcagatgggccagaaggtgcagctgcccgcagaaaccctccaggagctgctggacctgcacagggttagtgagagggaggccactgaagtctatatgaagaactctttcaaggatgtggaccatctgtttcaaaagaaattagcggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacctggagaaaaagtactatgaggaaccaaggaaggggatacaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccaccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatattttccataggaaggtaaagaaatcattagcaagagtaggaattgaatcataaacaaattggctaatgaagaaatcttttctttcttgttcaattcatctagattataaccttaatgtgacacctgagacctttagacagttgaccctgaattaaatagtcacatggtaacaattatgcactgtgtaattttagtaatgtataacatgcaatgatgcactttaactgaagatagagactatgttagaaaattgaactaatttaattatttgattgttttaatcctaaagcataagttagtcttttcctgattcttaaaggtcatacttgaaatcctgccaattttccccaaagggaatatggaatttttttgactttcttttgagcaataaaataattgtcttgccattacttagtatatgtagacttcatcccaattgtcaaacatcctaggtaagtggttgacatttcttacagcaattacagattatttttgaactagaaataaactaaactagaaataaaataagtttcactagtt

SEQ ID NO: 290633 - DNA, 2695 bp, Homo sapiens
cagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtagtatccttttgtgacccagaacagcaccaaggtcagaggggacacctgtattcataaaccagctgcctgactgtgaatcctgatgaatcaagctcaaaaggagaaaacaaaaaataatgcaagtacagaggagagatcccatctatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccaccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatattttccataggaaggtaaagaaatcattagcaagagtaggaattgaatcataaacaaattggctaatgaagaaatcttttctttcttgttcaattcatctagattataaccttaatgtgacacctgagacctttagacagttgaccctgaattaaatagtcacatggtaacaattatgcactgtgtaattttagtaatgtataacatgcaatgatgcactttaactgaagatagagactatgttagaaaattgaactaatttaattatttgattgttttaatcctaaagcataagttagtcttttcctgattcttaaaggtcatacttgaaatcctgccaattttccccaaagggaatatggaatttttttgactttcttttgagcaataaaataattgtcttgccattacttagtatatgtagacttcatcccaattgtcaaacatcctaggtaagtggttgacatttcttacagcaattacagattatttttgaactagaaataaactaaactagaaataaaataagtttcactagtt

SEQ ID NO: 290634 - DNA, 2649 bp, Homo sapiens
cagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtagtatccttttgtgacccagaacagcaccaaggtcagaggggacacctgtattcataaaccagctgcctgactgtgaatcctgatgaatcaagctcaaaaggagaaaacaaaaaataatgcaagtacagaggagagatcccatctatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgctgaagagattctgcagacatacttgaaatccaaggagtctgtgaccgatgcaattctacagacagaccagattctcacagaaaaggaaaaggagattgaagggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccaccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatattttccataggaaggtaaagaaatcattagcaagagtaggaattgaatcataaacaaattggctaatgaagaaatcttttctttcttgttcaattcatctagattataaccttaatgtgacacctgagacctttagacagttgaccctgaattaaatagtcacatggtaacaattatgcactgtgtaattttagtaatgtataacatgcaatgatgcactttaactgaagatagagactatgttagaaaattgaactaatttaattatttgattgttttaatcctaaagcataagttagtcttttcctgattcttaaaggtcatacttgaaatcctgccaattttccccaaagggaatatggaatttttttgactttcttttgagcaataaaataattgtcttgccattacttagtatatgtagacttcatcccaattgtcaaacatcctaggtaagtggttgacatttcttacagcaattacagattatttttgaactagaaataaactaaactagaaataaaataagtttcactagtt

SEQ ID NO: 290635 - DNA, 1884 bp, Homo sapiens
ctctgcctgatatcctccctgcatccccacagttctctccctctcttcctccctctatctgaatcactctgatttgctctctcaaggagggcttcattctccagtcagctcagcccatatggaaccacagcatcaaatttagagccctcaatttgaaaaggacagggaatcttatttcccagtatctgtatcatcctcctaaataagactctgctaagtagggtcatctgattggccagcttggagcatgtatctggccctgtgatagggaatcttgaccaccaggcacaccagggccaagaggaagaattctcagaagaaaagatggtgggcagaagaacaggaaaacctgcttacagccatttcctacttctcactctgtgttctctgggtcctaaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccaccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatattttccataggaaggtaaagaaatcattagcaagagtaggaattgaatcataaacaaattggctaatgaagaaatcttttctttcttgttcaattcatctagattataaccttaatgtgacacctgagacctttagacagttgaccctgaattaaatagtcacatggtaacaattatgcactgtgtaattttagtaatgtataacatgcaatgatgcactttaactgaagatagagactatgttagaaaattgaactaatttaattatttgattgttttaatcctaaagcataagttagtcttttcctgattcttaaaggtcatacttgaaatcctgccaattttccccaaagggaatatggaatttttttgactttcttttgagcaataaaataattgtcttgccattacttagtatatgtagacttcatcccaattgtcaaacatcctaggtaagtggttgacatttcttacagcaattacagattatttttgaactagaaataaactaaactagaaataaaataagtttcactagtt

SEQ ID NO: 290636 - DNA, 1962 bp, Homo sapiens
cagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtactatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgtctagagagcctagtgctgacctatatcaatgctatcagcagaggggatctgccctgcatggagaacgcagtcctggccttggcccagatagagaactcagccgcagtgcaaaaggctattgcccactatgaccagcagatgggccagaaggtgcagctgcccgcagaaaccctccaggagctgctggacctgcacagggttagtgagagggaggccactgaagtctatatgaagaactctttcaaggatgtggaccatctgtttcaaaagaaattagcggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacctggagaaaaagtactatgaggaaccaaggaaggggatacaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggtatccaaatgcatcaccttgtggttcgtttttctgttttctctctgttcttcctgatcacaaacttagtatggcagagcgaacataaagcccaggggaagga

SEQ ID NO: 290637 - DNA, 1922 bp, Homo sapiens
cagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtactatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgtctagagagcctagtgctgacctatatcaatgctatcagcagaggggatctgccctgcatggagaacgcagtcctggccttggcccagatagagaactcagccgcagtgcaaaaggctattgcccactatgaccagcagatgggccagaaggtgcagctgcccgcagaaaccctccaggagctgctggacctgcacagggttagtgagagggaggccactgaagtctatatgaagaactctttcaaggatgtggaccatctgtttcaaaagaaattagcggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacctggagaaaaagtactatgaggaaccaaggaaggggatacaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggttggtggtatagctagctgataccaccaaatgtcagcattttaatccttaaagtcatctcttgattggtgtgttctttctttatttatttttaataaaaaattgtatttgcttagaagcattcagaatgtcaacaaaatggctacaactttttcttttcttttttttttattttttggcaataacaggggggtatagggtaccgagcccaaa

SEQ ID NO: 290638 - DNA, 1241 bp, Homo sapiens
cagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtactatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgctgaagagattctgcagacatacttgaaatccaaggagtctgtgaccgatgcaattctacagacagaccagattctcacagaaaaggaaaaggagattgaagtggaacgtgtaaaagctgaatctgcacaggctttagccaagagtatcaagaacagtgaaacacttgactg

SEQ ID NO: 290639 - DNA, 360 bp, Homo sapiens
aaggtcagaggggacacctgtattcataaaccagctgcctgactgtgaatcctgatgaatcaagctcaaaaggagaaaacaaaaaataatgcaagtacagaggagagatcccatgtatccactttagaattgacacttaggttaggatcaaaggaaaatggaaggtttgggaatgtgttgaactaatatgggatgaggttcctgttcattttgtcacatttccttagttagctactcagctatgtgacagagctgacacatcgaatccgatcaaaatcctcacctgatgagaatgagaatgaggattcagctgactttgtgagcttcttcccagattttgtgtggacactgagagatttc

SEQ ID NO: 290640 - DNA, 327 bp, Homo sapiens
caaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaagtaacagagacgtaccattgataaatgaggacgacaaaacactagaaattatcattttttagtttactattgatagttttctcacatttacagttttctatatctctagcttgctattcttaagaattaatgcttgctattagcaatagaaaaggttttttga

SEQ ID NO: 290641 - DNA, 1600 bp, Homo sapiens
cttgacttcccggacagactgcgacctccttgaggatggaatcggtattttggttaaatttatttctgcatgggccttgcacataaaaaacgtttattgaacaaacgaatcctgtatgttcctccccccaggcaggaaacgctccctgggagggagggtagtctattggtgagctaggacgtttggactcagggttccgaggaaccaggagcgatccttagtgggccgagacttccgaatttgatcaaaggtaaagagggactggagagcggtccatctgacttctgtgggggatgggcaggagtcaggggcggacgcctgaatcttgtttctcagaagagccgagaggcctaggctcaagcttggggcgatccggtacttggaggttcgaagctcctagtttcgggttgagaccgatgtggagggcgatgacgcgcgggttccttgacatcgaggatcagtaacacccggagtgggtggggaacgaggggggcggcccctgagctcaggccccgcccctttccggggacgtttcaccggattggctgtccttccataacgacatgcggccccgccccggcgcgcgccccgccgcgtgcccagcccgggtagctgctgcagcctacgctgcctcggccactgcctgccgcgtgcggagccggagcccgagcctgagtggcgccgggcccgacgtggggctcctgggccgcggcggcgggcgggcgatgctccagaggcctgaccagccatggaggccgaggcaggcggcctggaggagctgacggacgaggagatggcggcgctaggcaaggaagagctagtgcggcgcctgcggcgggaggaggcggcgcgcctggcggcactggtgcagcgcggccgcctcatgcaggaggtgaatcggcagctgcagggccacctgggcgagatccgcgagctcaagcagctcaaccggcgtctgcaggcagagaaccgtgagctgcgcgacctctgctgcttcctggactcggagcgccagcgcgggcggcgcgccgcacgccagtggcagctcttcgggacccaagcatcccgggccgtgcgcgaggacctgggcggctgttggcagaagctggccgagctggagggccgccaggaggagctgctgcgggagaacctagcgcttaaggagctctgcctggcgctgggcgaagaatggggcccccgcggcggccccagcggcgccgggggatcaggagccgggccagcacccgagcttgccttgcccccgtgcgggccccgcgacctaggcgatggaagctccagcactggcagcgtgggcagtccggatcagttgcccctggcctgttcccccgatgattgaaggcactgcttcctccacgccgacgcccgcccggattgctccccgagccccgggaccgctgtggacctcgggacctggacgccgtcctggctgcgcaggaggggccgctggcatggactaagaaatcctgacaccaagaagggcccctcgctcttgctggcagggcagcagggggactgaaggctggagcggagggacttgctgggggttggattgggggtaataaacccggacggaagcgga

SEQ ID NO: 290642 - DNA, 2062 bp, Homo sapiens
cttgacttcccggacagactgcgacctccttgaggatggaatcggtattttggttaaatttatttctgcatgggccttgcacataaaaaacgtttattgaacaaacgaatcctgtatgttcctccccccaggcaggaaacgctccctgggagggagggtagtctattggtgagctaggacgtttggactcagggttccgaggaaccaggagcgatccttagtgggccgagacttccgaatttgatcaaaggtaaagagggactggagagcggtccatctgacttctgtgggggatgggcaggagtcaggggcggacgcctgaatcttgtttctcagaagagccgagaggcctaggctcaagcttggggcgatccggtacttggaggttcgaagctcctagtttcgggttgagaccgatgtggagggcgatgacgcgcgggttccttgacatcgaggatcagtaacacccggagtgggtggggaacgaggggggcggcccctgagctcaggccccgcccctttccggggacgtttcaccggattggctgtccttccataacgacatgcggccccgccccggcgcgcgccccgccgcgtgcccagcccgggtagctgctgcagcctacgctgcctcggccactgcctgccgcgtgcggagccggagcccgagcctgagtggcgccgggcccgacgtggggctcctgggccgcggcggcgggcgggcgatgctccagaggcctgaccagccatggaggccgaggcaggcggcctggaggagctgacggacgaggagatggcggcgctaggcaaggaagagctagtgcggcgcctgcggcgggaggaggcggcgcgcctggcggcactggtgcagcgcggccgcctcatgcaggaggtgaatcggcagctgcagggccacctgggcgagatccgcgagctcaagcagctcaaccggcgtctgcaggcagagaaccgtgagctgcgcgacctctgctgcttcctggactcggagcgccagcgcgggcggcgcgccgcacgccagtggcagctcttcgggacccaagcatcccgggccgtgcgcgaggacctgggcggctgttggcagaagctggccgagctggagggccgccaggaggagctgctgcgggagaacctagcgcttaaggagctctgcctggcgctgggcgaagaatggggcccccgcggcggccccagcggcgccgggggatcaggagccgggccagcacccgagcttgccttgcccccgtgcgggccccgcgacctaggcgatggaagctccagcactggcagcgtgggcagtccggatcagttgcccctggcctgttcccccgatgattgaaggcactgcttcctccacgccgacgcccgcccggattgctccccgagccccgggaccgctgtggacctcgggacctggacgccgtcctggctgcgcaggaggggccgctggcatggactaagaaatcctgacaccaagaagggcccctcgctcttgctggcagggcagcagggggactgaaggctggagcggagggacttgctgggggttggattgggggtaataaacccggacggaagcggagccacggcctgggcagcgtctgtttggtactcgccggggttggggcgagggtggggtgctgatacagggtacaattcccatccagaaggactgcagaactaatgattcccccattacttcgagcctggggtgggatgcggggcagtggtaaaccagacttcccccatcgggcgccgggaccggccttaatccagcccctgaagtggctccagctcccttcccggctccttcctgtccaagacaatggggcaggaagcaggtgctgggggcctagaaccactcggccgcctcctctgaggctggaagggggcataacagcgcccctccgtggcacacgcagcagcactgtgggcccccacggggagaggggcggtaagcctcttcgcttttaccccagaggactgtctcccctcagtcccggagatgaggccgagcggatgtagccccacttgtcagataaga

SEQ ID NO: 290643 - DNA, 1302 bp, Homo sapiens
cttgacttcccggacagactgcgacctccttgaggatggaatcggtattttggttaaatttatttctgcatgggccttgcacataaaaaacgtttattgaacaaacgaatcctgtatgttcctccccccaggcaggaaacgctccctgggagggagggtagtctattggtgagctaggacgtttggactcagggttccgaggaaccaggagcgatccttagtgggccgagacttccgaatttgatcaaaggtaaagagggactggagagcggtccatctgacttctgtgggggatgggcaggagtcaggggcggacgcctgaatcttgtttctcagaagagccgagaggcctaggctcaagcttggggcgatccggtacttggaggttcgaagctcctagtttcgggttgagaccgatgtggagggcgatgacgcgcgggttccttgacatcgaggatcagtaacacccggagtgggtggggaacgaggggggcggcccctgagctcaggccccgcccctttccggggacgtttcaccggattggctgtccttccataacgacatgcggccccgccccggcgcgcgccccgccgcgtgcccagcccgggtagctgctgcagcctacgctgcctcggccactgcctgccgcgtgcggagccggagcccgagcctgagtggcgccgggcccgacgtggggctcctgggccgcggcggcgggcgggcgatgctccagaggcctgaccagccatggaggccgaggcaggcggcctggaggagctgacggacgaggagatggcggcgctaggcaaggaagagctagtgcggcgcctgcggcgggaggaggggagaacctagcgcttaaggagctctgcctggcgctgggcgaagaatggggcccccgcggcggccccagcggcgccgggggatcaggagccgggccagcacccgagcttgccttgcccccgtgcgggccccgcgacctaggcgatggaagctccagcactggcagcgtgggcagtccggatcagttgcccctggcctgttcccccgatgattgaaggcactgcttcctccacgccgacgcccgcccggattgctccccgagccccgggaccgctgtggacctcgggacctggacgccgtcctggctgcgcaggaggggccgctggcatggactaagaaatcctgacaccaagaagggcccctcgctcttgctggcagggcagcagggggactgaaggctggagcggagggacttgctgggggttggattgggggtaataaacccggacggaagcgga

SEQ ID NO: 290644 - DNA, 1662 bp, Homo sapiens
cttgacttcccggacagactgcgacctccttgaggatggaatcggtattttggttaaatttatttctgcatgggccttgcacataaaaaacgtttattgaacaaacgaatcctgtatgttcctccccccaggcaggaaacgctccctgggagggagggtagtctattggtgagctaggacgtttggactcagggttccgaggaaccaggagcgatccttagtgggccgagacttccgaatttgatcaaaggtaaagagggactggagagcggtccatctgacttctgtgggggatgggcaggagtcaggggcggacgcctgaatcttgtttctcagaagagccgagaggcctaggctcaagcttggggcgatccggtacttggaggttcgaagctcctagtttcgggttgagaccgatgtggagggcgatgacgcgcgggttccttgacatcgaggatcagtaacacccggagtgggtggggaacgaggggggcggcccctgagctcaggccccgcccctttccggggacgtttcaccggattggctgtccttccataacgacatgcggccccgccccggcgcgcgccccgccgcgtgcccagcccgggtagctgctgcagcctacgctgcctcggccactgcctgccgcgtgcggagccggagcccgagcctgagtggcgccgggcccgacgtggggctcctgggccgcggcggcgggcgggcgatgctccagaggcctgaccagccatggaggccgaggcaggcggcctggaggagctgacggacgaggagatggcggcgctaggcaaggaagagctagtgcggcgcctgcggcgggaggaggcggcgcgcctggcggcactggtgcagcgcggccgcctcatgcaggaggtgaatcggcagctgcagggccacctgggcgagatccgcgagctcaagcagctcaaccggcgtctgcaggcagagaaccgtgagctgcgcgacctctgctgcttcctggactcggagcgccagcgcgggcggcgcgccgcacgccagtggcagctcttcgggacccaagcatcccgggccgtgcgcgaggacctgggcggctgttggcagaagctggccgagctggagggccgccaggaggagctgctgcgggagaacctagcgcttaaggagctctgcctggcgctgggcgaagaatggggcccccgcggcggccccagcggcgccgggggatcaggagccgggccagcacccgagcttgccttgcccccgtgcgggccccgcgacctaggcgatggaagctccagcactggcagcgtgggcagtccggatcagttgcccctggcctgttcccccgatgattgaaggcactgcttcctccacgccgacgcccgcccggattgctccccgagccccgggaccgctgtggacctcgggacctggacgccgtcctggctgcgcaggaggggccgctggcatggactaagaaatcctgacaccaagaagggcccctcgctcttgctggcagggcagcagggggactgaaggctggagcggaacatgattggggggttaggaatttggggggtaaaataaaacccgggaaccggaaaacctggggaacatatagataactatggtgctaatagcaagctatggacgagatataa

SEQ ID NO: 290645 - DNA, 1440 bp, Homo sapiens
cttgacttcccggacagactgcgacctccttgaggatggaatcggtattttggttaaatttatttctgcatgggccttgcacataaaaaacgtttattgaacaaacgaatcctgtatgttcctccccccaggcaggaaacgctccctgggagggagggtagtctattggtgagctaggacgtttggactcagggttccgaggaaccaggagcgatccttagtgggccgagacttccgaatttgatcaaaggtaaagagggactggagagcggtccatctgacttctgtgggggatgggcaggagtcaggggcggacgcctgaatcttgtttctcagaagagccgagaggcctaggctcaagcttggggcgatccggtacttggaggttcgaagctcctagtttcgggttgagaccgatgtggagggcgatgacgcgcgggttccttgacatcgaggatcagtaacacccggagtgggtggggaacgaggggggcggcccctgagctcaggccccgcccctttccggggacgtttcaccggattggctgtccttccataacgacatgcggccccgccccggcgcgcgccccgccgcgtgcccagcccgggtagctgctgcagcctacgctgcctcggccactgcctgccgcgtgcggagccggagcccgagcctgagtggcgccgggcccgacgtggggctcctgggccgcggcggcgggcgggcgatgctccagaggcctgaccagccatggaggccgaggcaggcggcctggaggagctgacggacgaggagatggcggcgctaggcaaggaagagctagtgcggcgcctgcggcgggaggaggcggcgcgcctggcggcactggtgcagcgcggccgcctcatgcaggaggtgaatcggcagctgcagggccacctgggcgagatccgcgagctcaagcagctcaaccggcgtctgcaggcagagaaccgtgagctgcgcgacctctgctgcttcctggactcggagcgccagcgcgggcggcgcgccgcacgccagtggcagctcttcgggacccaagcatcccgggccgtgcgcgaggacctgggcggctgttggcagaagctggccgagctggagggccgccaggaggagctgctgcgggagaacctagcgcttaaggagctctgcctggcgctgggcgaagaatggggcccccgcggcggccccagcggcgccgggggatcaggagccgggccagcacccgagcttgccttgcccccgtgcgggccccgcgacctaggcgatggaagctccagcactggcagcatggactaagaaatcctgacaccaagaagggcccctcgctcttgctggcagggcagcagggggactgaaggctggagcggagggacttgctgggggttggattgggggtaataaacccggacggaagcgga

SEQ ID NO: 290646 - DNA, 1331 bp, Homo sapiens
cttgacttcccggacagactgcgacctccttgaggatggaatcggtattttggttaaatttatttctgcatgggccttgcacataaaaaacgtttattgaacaaacgaatcctgtatgttcctccccccaggcaggaaacgctccctgggagggagggtagtctattggtgagctaggacgtttggactcagggttccgaggaaccaggagcgatccttagtgggccgagacttccgaatttgatcaaaggtaaagagggactggagagcggtccatctgacttctgtgggggatgggcaggagtcaggggcggacgcctgaatcttgtttctcagaagagccgagaggcctaggctcaagcttggggcgatccggtacttggaggttcgaagctcctagtttcgggttgagaccgatgtggagggcgatgacgcgcgggttccttgacatcgaggatcagtaacacccggagtgggtggggaacgaggggggcggcccctgagctcaggccccgcccctttccggggacgtttcaccggattggctgtccttccataacgacatgcggccccgccccggcgcgcgccccgccgcgtgcccagcccgggtagctgctgcagcctacgctgcctcggccactgcctgccgcgtgcggagccggagcccgagcctgagtggcgccgggcccgacgtggggctcctgggccgcggcggcgggcgggcgatgctccagaggcctgaccagccatggaggccgaggcaggcggcctggaggagctgacggacgaggagatggcggcgctaggcaaggaagagctagtgcggcgcctgcggcgggaggaggcggcgcgcctggcggcactggtgcagcgcggccgcctcatgcaggaggtgaatcggcagctgcagggccacctgggcgagatccgcgagctcaagcagctcaaccggcgtctgcaggcagagaaccgtgagctgcgcgacctctgctgcttcctggactcggagcgccagcgcgggcggcgcgccgcacgccagtggcagctcttcgggacccaagcatcccgggccgtgcgcgaggacctgggcggctgttggcagaagctggccgagctggagggccgccaggaggagctgctgcgggagaacctagcgcttaaggagctctgcctggcgctgggcgaagaatggggcccccgcggcggccccagcggcgccgggggatcaggagccgggccagcacccgagcttgccttgcccccgtgcgggccccgcgacctgggacttgctgggggttggattgggggtaataaacccggacggaagcgga

SEQ ID NO: 290647 - DNA, 1923 bp, Homo sapiens
cttgacttcccggacagactgcgacctccttgaggatggaatcggtattttggttaaatttatttctgcatgggccttgcacataaaaaacgtttattgaacaaacgaatcctgtatgttcctccccccaggcaggaaacgctccctgggagggagggtagtctattggtgagctaggacgtttggactcagggttccgaggaaccaggagcgatccttagtgggccgagacttccgaatttgatcaaaggtaaagagggactggagagcggtccatctgacttctgtgggggatgggcaggagtcaggggcggacgcctgaatcttgtttctcagaagagccgagaggcctaggctcaagcttggggcgatccggtacttggaggttcgaagctcctagtttcgggttgagaccgatgtggagggcgatgacgcgcgggttccttgacatcgaggatcagtaacacccggagtgggtggggaacgaggggggcggcccctgagctcaggccccgcccctttccggggacgtttcaccggattggctgtccttccataacgacatgcggccccgccccggcgcgcgccccgccgcgtgcccagcccgggtagctgctgcagcctacgctgcctcggccactgcctgccgcgtgcggagccggagcccgagcctgagtggcgccgggcccgacgtggggctcctgggccgcggcggcgggcgggcgatgctccagaggcctgaccagccatggaggccgaggcaggcggcctggaggagctgacggacgaggagatggcggcgctaggcaaggaagagctagtgcggcgcctgcggcgggaggaggcggcgcgcctggcggcactggtgcagcgcggccgcctcatgcaggaggtgaatcggcagctgcagggccacctgggcgagatccgcgagctcaagcagctcaaccggcgtctgcaggcagagaaccgtgagctgcgcgacctctgctgcttcctggactcggagcgccagcgcgggcggcgcgccgcacgccagtggcagctcttcgggacccaagcatcccgggccgtgcgcgaggacctgggcggctgttggcagaagctggccgagctggagggccgccaggaggagctgctgcaggcgatggaagctccagcactggcagcgtgggcagtccggatcagttgcccctggcctgttcccccgatgattgaaggcactgcttcctccacgccgacgcccgcccggattgctccccgagccccgggaccgctgtggacctcgggacctggacgccgtcctggctgcgcaggaggggccgctggcatggactaagaaatcctgacaccaagaagggcccctcgctcttgctggcagggcagcagggggactgaaggctggagcggagggacttgctgggggttggattgggggtaataaacccggacggaagcggagccacggcctgggcagcgtctgtttggtactcgccggggttggggcgagggtggggtgctgatacagggtacaattcccatccagaaggactgcagaactaatgattcccccattacttcgagcctggggtgggatgcggggcagtggtaaaccagacttcccccatcgggcgccgggaccggccttaatccagcccctgaagtggctccagctcccttcccggctccttcctgtccaagacaatggggcaggaagcaggtgctgggggcctagaaccactcggccgcctcctctgaggctggaagggggcataacagcgcccctccgtggcacacgcagcagcactgtgggcccccacggggagaggggcggtaagcctcttcgcttttaccccagaggactgtctcccctcagtcccggagatgaggccgagcggatgtagccccacttgtcagataaga

SEQ ID NO: 290648 - DNA, 744 bp, Homo sapiens
gctgggcccgccgcgttcgcaccaagcacgccaggcggccctggcctacctccctcccgcctcccagcagctggcacgagggaacctggccgtcaggtttcccctgggatcctgggacggtatcaggcggggaatctgtgcggccgcggcgaggtgatttatttggcataaaagtattctttcaaggatggcagaagctgttttgattgatctttttggtttgaaattgaactctcaaaaaaactgccatcagacattactgaagactttgaatgctgtccaataccaccatgctgccaaggccaagtttctctgtataatgtgttgcagtaacatcagctatgaaagggatggagaacaagataattgtgaaatagaaacaagcaatggattatcagctctcttggaagaatttgagattgttagctgtcccagcatggctgccactttgtataccattaaacagaaaattgatgaaaaaaatctgagcagcattaagatattttcatacatggatttactacaagaacaggtgggatatcttatataccaactcttagctcattcaatctcttcagtagttccaaacggagagatcccaaggtagtggttcaagataaagactcatcattccaatgacatctggattatgggaagaaaggagcctgactcttatgatggaataaccacaaatcagagaggagtcacaatagcagctcttggtgcagactgtataccgatagt

SEQ ID NO: 290649 - DNA, 940 bp, Homo sapiens
gctgggcccgccgcgttcgcaccaagcacgccaggcggccctggcctacctccctcccgcctcccagcagctggcacgagggaacctggccgtcaggtttcccctgggatcctgggacggtatcaggcggggaatctgtgcggccgcggcgaggtgatttatttggcataaaagtattctttcaaggatggcagaagctgttttgattgatctttttggtttgaaattgaactctcaaactgccaaggccaagtttctctgtataatgtgttgcagtaacatcagctatgaaagggatggagaacaagataattgtgaaatagaaacaagcaatggattatcagctctcttggaagaatttgagattgttagctgtcccagcatggctgccactttgtataccattaaacagaaaattgatgaaaaaaatctgagcagcattaaggtaattgtacccaggcacaggaagacattaatgaaagcttttattgatcaactcttcactgatgtttacaattttgaatttgaagatttgcaagtgacttttaggggagggctttttaaacagtccattgaaataaacgtaatcacagctcaagaactaagaggaattcagaatgaaatagaaacatttttgagaagtctgccagcactgagaggaaaattaactattatcacttcttctttgatcccagatattttcatacatggatttactacaagaacaggtgggatatcttatataccaactcttagctcattcaatctcttcagtagttccaaacggagagatcccaaggtagtggttcaagataaagactcatcattccaatgacatctggattatgggaagaaaggagcctgactcttatgatggaataaccacaaatcagagaggagtcacaatagcagctcttggtgcagactgtataccgatagt

SEQ ID NO: 290650 - DNA, 548 bp, Homo sapiens
ggtctggggaataaagaatgggatgaaatggtgagagtccagaggggttgagcaaagaactcactatcacacagcaaggcactaatttgaaatgcctgggagaagtagaagctgcatttgactctcatattcttattggaccaggaaggcaggaggagacaccagtgtgcaccagagaaggagaagtcagagatgacagtccctgcctgaggccatctctggtccaccagacaactcatcaccaacttcccaacagccactgctctaggccagacttggatctgctcttgaatctgcccctgcggaaagagggccgtttggacaggctgtgcctggagatttctggcctcataaaatcctcctggtctcttaggagagctggtgacactctccaggtccttggtggagcctgatgattgacatcttaagcaaattctctggagaagtcgatgctcctgatggaggctcacacattgataacccctggtttagagacactactaattgttccagctcatccagctaataaatgacagatctcagactta

SEQ ID NO: 290651 - DNA, 844 bp, Homo sapiens
ttaaggacccaggacagggcatctggacatggctgtgtgaatgtttggctcgctctgttccagcggctctcccagaagttgggaggggtgaagatccccttgggctgtccgctcttgggtccatggcttgaagaagaatccccttctgctcactatgaacatggcttatgacctcgcagagagcaaagataaggagacccagagccaggaaaaggtctcagcccccaggatcctctccaccttcccatcctccctcagctgaacatggtagcctcagaaggaaagggcttcactgaagatgatgatttgctcaaagaggaagacgcgcctctctcgacctcgggaagacagcagccctccagcctcaggctcggtgacccagaaagtgtcctggcccaagagcttcccctgagcagtcagtttgccctgaaaccaaaaggatagtggccttggaaaaagaacaagaaaaaggacaattctctgctcctcccttcctcgcctgacatgcccaaccaaccatggggtcagccccaggagaagacaactccccataaggacctcctgaatgctagggctggggcagaagagcatcgggcctccagtttcttgccctatctccgtacctcaaatccccgcaatctccccagcgtcatcatatcgttgcagcgcttgggcacaaagcacatgacctccacagcttgctgggacacagttcactcaggacatacctaggatgaaagcaggaggaggcccccacttcagcgtcggagctcatccttggttcagcccgttcctccctcctcccctttatcatcatagccaaccttggaggaaattccatcta

SEQ ID NO: 290652 - DNA, 680 bp, Homo sapiens
aagcagctgtaaggtttttggtagctgtcagtgctagcaaacagtgcttttctcacagaactactggaaagagtcctggctcggaaaacttgctcttgaaagtggcacggccagagcaggggtctctagagggtcgtgccacctctacctgccacaggttccattgtcggtcagcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290653 - DNA, 1722 bp, Homo sapiens
gaaagaggtttttaaattctccatgaagtgtactatgttccatcattccttcccaaagccaccggaagcattccttctaggaaaggtggagtcggtagtgagaagccggaggtgagaagacccctgagcggatggattcattcattttctgaatttcctatgtgaggacagtattagagcccagtgaggctttgagaggccccaaagatgagcgccaacagcagcagagtgggccagcttctcttgcagggttcagcgtgcattaggtggaagcaggatgtggaaggggctgtctaccacctagccaactgcctcttactcctgggcttcatggggggcagtggggtgtatggatgcttctatctttttggcttcctgagtgcaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacctcctctacaagacgctgtgcctgcccttgcaggtgcccctacagacatacaaggagattgttcactgctgcgaggagcaggtcttaactctggccactgaacagacctatgctgtggagggtgagacacccatcaaccgcctgtccctgctgctctctggccgggttcgtgtgagccaggatgggcagtttctgcactacatctttccataccagttcatggactctcctgagtgggaatcactacagccttctgaggagggggtgttccaggtcactctgactgctgagacctcatgtagctacatttcctggccccggaaaagtctccatcttcttctgaccaaagagcgatacatctcctgcctcttctcggctctgctgggatatgacatctcggagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290654 - DNA, 616 bp, Homo sapiens
  misc_feature (26)..(26): n is a, c, g, or t
  misc_feature (30)..(30): n is a, c, g, or t
agaaatataggaacaagaaccagaantgtngcgcgcccgcggttttcgccctataccgtcccgcataggtgagatatcagcccggatgtattattatatactctaacagacttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290655 - DNA, 586 bp, Homo sapiens
aattatagatgggcttttcccctttatttatctcctttattcttcttataatcattcaccacacacaatttcccctcatacttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290656 - DNA, 1117 bp, Homo sapiens
tgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtgagtataggtgcttggagaggataaggaaatcaccctgatccaatagctggtaacctgcgaggcatatcatatctcatgactatggtaacttcaagcattacatcgtcacgcaactattcaagcctggatgaaagcatgaaccagcatggacaagtaacaaacagtttgaagaccaggctgagttcatgaccacacttgttgactctggtgacttcataagatggcccccgcctgcctcgcctgcctcttgtctgctgctccttttgattcacctacaacaagctgttctctgttaccagaatatgccacgtattttgttttacttctgggactgactttacaatctgttctttcttcctggaatgccctcctctagctggggaaaacctactcatctttttagaccagattaaaagtcaccttccctgtgatgttttctcgtggaaaaaaatatttttttaagagacagtggtctcactatgttgcctaggctggtctcaaactcctgggcacaagtgatcctcccatctcagcctcccagaatactgggattgtagacataagccatcacgcccccaacctcatgaattttagttaggttatagcagtatagtaaaagtccctatggattgaattatttgctccctcataagtgttttttctttgaatcctaagtacacttattttattggattacagtttctgagtcagtatccgggatagactgaaagtttcttgaagtgataattgtcttattcatctttatatcccctgttcttggaacacatagtctgtcctgaataaatgcctattgaattgaatcagctcaacaaatgagaaaac

SEQ ID NO: 290657 - DNA, 901 bp, Homo sapiens
  misc_feature (26)..(26): n is a, c, g, or t
  misc_feature (764)..(764): n is a, c, g, or t
taagtgaatagttataaacaaacaanccccccgcccacgcccctctacttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttcaaaaacaaaaaatcggcctgcgatggccctcaacgatggaagctcttgcggccgctttccctttaatggaggggcttaattcatcgacccttcgctcacttgcactccctcgcacttccggtcgtatcagtgtggcggaaaagacgttttcaagcttcacttcaataggcaggtaataacgtgtcttttcaactaaattctcggggtgttnacctaatatgataaaaacatcgttagtccataaagggcccagtaaataaggcctgagaacccggaataatgcgcctgtgtgagattggaatttatattattatgcattcgctccccttgacgagattcacatataat

SEQ ID NO: 290658 - DNA, 494 bp, Homo sapiens
aagcagctgtaaggtttttggtagctgtcagtgctagcaaacagtgcttttctcacagaactactggaaagagtcctggctcggaaaacttgctcttgaaagtggcacggccagagcaggggtctctagagggtcgtgccacctctacctgccacaggttccattgtcggtcaggtaagttagaggcagcagttccccacctgccctctggataacagcagcctggggctgctcctgagtcatgtttccacttctgtcttacaggcctcattttcctacccatctttctgtaaaaatgaaagtcaggagtcttatgaaacttaccattattcaatacaggcttttggtttttttctttaaattagatagggttaggtaagaagtagagttctatagaacgttcataggaagcaatggcaccaaaagccaaaattgacaaatgggatctgattaactaagggcttctccacagcaaaagactccctcagggtgac

SEQ ID NO: 290659 - DNA, 1465 bp, Homo sapiens
tgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtgagtataggtgcttggagaggataaggaaatcaccctgatccaatagctggtaacctgcgaggcatatcatatctcatgactatggtaacttcaagcattacatcgtcacgcaactattcaagcctggatgaaaggtcactctgactgctgagacctcatgtagctacatttcctggccccggaaaagtctccatcttcttctgaccaaagagcgatacatctcctgcctcttctcggctctgctgggatatgacatctcggagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggggtgaggactccaccagtctggtgctggaggattttgaggaggtgtcaggatcagaatcgtttatggattataggagtgatggggagtacatgaggtgaagggagaactaacatgggcacagccaccggctcaggatcctatcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290660 - DNA, 1408 bp, Homo sapiens
gaaagaggtttttaaattctccatgaagtgtactatgttccatcattccttcccaaagccaccggaagcattccttctaggaaaggtggagtcggtagtgagaagccggaggtgcccctacagacatacaaggagattgttcactgctgcgaggagcaggtcttaactctggccactgaacagacctatgctgtggagggtgagacacccatcaaccgcctgtccctgctgctctctggccgggttcgtgtgagccaggatgggcagtttctgcactacatctttccataccagttcatggactctcctgagtgggaatcactacagccttctgaggagggggtgttccaggtcactctgactgctgagacctcatgtagctacatttcctggccccggaaaagtctccatcttcttctgaccaaagagcgatacatctcctgcctcttctcggctctgctgggatatgacatctcggagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggggtgaggactccaccagtctggtgctggaggattttgaggaggtgtcaggatcagaatcgtttatggattataggagtgatggggagtacatgaggtgaagggagaactaacatgggcacagccaccggctcaggatcctatcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290661 - DNA, 1705 bp, Homo sapiens
tgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtgagtataggtgcttggagaggataaggaaatcaccctgatccaatagctggtaacctgcgaggcatatcatatctcatgactatggtaacttcaagcattacatcgtcacgcaactattcaagcctggatgaaaggtgcccctacagacatacaaggagattgttcactgctgcgaggagcaggtcttaactctggccactgaacagacctatgctgtggagggtgagacacccatcaaccgcctgtccctgctgctctctggccgggttcgtgtgagccaggatgggcagtttctgcactacatctttccataccagttcatggactctcctgagtgggaatcactacagccttctgaggagggggtgttccaggtcactctgactgctgagacctcatgtagctacatttcctggccccggaaaagtctccatcttcttctgaccaaagagcgatacatctcctgcctcttctcggctctgctgggatatgacatctcggagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggggtgaggactccaccagtctggtgctggaggattttgaggaggtgtcaggatcagaatcgtttatggattataggagtgatggggagtacatgaggtgaagggagaactaacatgggcacagccaccggctcaggatcctatcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290662 - DNA, 1755 bp, Homo sapiens
gaaagaggtttttaaattctccatgaagtgtactatgttccatcattccttcccaaagccaccggaagcattccttctaggaaaggtggagtcggtagtgagaagccggaggtgagaagacccctgagcggatggattcattcattttctgaatttcctatgtgaggacagtattagagcccagtgaggctttgagaggccccaaagatgagcgccaacagcagcagagtgggccagcttctcttgcagggttcagcgtgcattaggtggaagcaggatgtggaaggggctgtctaccacctagccaactgcctcttactcctgggcttcatggggggcagtggggtgtatggatgcttctatctttttggcttcctgagtgcaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacctcctctacaagacgctgtgcctgcccttgcaggtgcccctacagacatacaaggagattgttcactgctgcgaggagcaggtcttaactctggccactgaacagacctatgctgtggagggtgagacacccatcaaccgcctgtccctgctgctctctggccggtcactctgactgctgagacctcatgtagctacatttcctggccccggaaaagtctccatcttcttctgaccaaagagcgatacatctcctgcctcttctcggctctgctgggatatgacatctcggagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggggtgaggactccaccagtctggtgctggaggattttgaggaggtgtcaggatcagaatcgtttatggattataggagtgatggggagtacatgaggtgaagggagaactaacatgggcacagccaccggctcaggatcctatcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290663 - DNA, 1654 bp, Homo sapiens
gaaagaggtttttaaattctccatgaagtgtactatgttccatcattccttcccaaagccaccggaagcattccttctaggaaaggtggagtcggtagtgagaagccggaggtgagaagacccctgagcggatggattcattcattttctgaatttcctatgtgaggacagtattagagcccagtgaggctttgagaggccccaaagatgagcgccaacagcagcagagtgggccagcttctcttgcagggttcagcgtgcattaggtggaagcaggatgtggaaggggctgtctaccacctagccaactgcctcttactcctgggcttcatggggggcagtggggtgtatggatgcttctatctttttggcttcctgagtgcaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacctcctctacaagacgctgtgcctgcccttgcaggtgcccctacagacatacaaggagattgttcactgctgcgaggagcaggtcttaactctggccactgaacagacctatgctgtggagggtgagacacccatcaaccgcctgtccctgctgctctctggccggtcactctgactgctgagacctcatgtagctacatttcctggccccggaaaagtctccatcttcttctgaccaaagagcgatacatctcctgcctctctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggggtgaggactccaccagtctggtgctggaggattttgaggaggtgtcaggatcagaatcgtttatggattataggagtgatggggagtacatgaggtgaagggagaactaacatgggcacagccaccggctcaggatcctatcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290664 - DNA, 1299 bp, Homo sapiens
gaaagaggtttttaaattctccatgaagtgtactatgttccatcattccttcccaaagccaccggaagcattccttctaggaaaggtggagtcggtagtgagaagccggaggtgcccctacagacatacaaggagattgttcactgctgcgaggagcaggtcttaactctggccactgaacagacctatgctgtggagggtgagacacccatcaaccgcctgtccctgctgctctctggccggtcactctgactgctgagacctcatgtagctacatttcctggccccggaaaagtctccatcttcttctgaccaaagagcgatacatctcctgcctcttctcggctctgctgggatatgacatctcggagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggggtgaggactccaccagtctggtgctggaggattttgaggaggtgtcaggatcagaatcgtttatggattataggagtgatggggagtacatgaggtgaagggagaactaacatgggcacagccaccggctcaggatcctatcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290665 - DNA, 1333 bp, Homo sapiens
catgtcctgggtcccactgctgcagatgctggaccagagtcgagaagggtgatgaggaagtctgtgagccagctgtgtcccctcctcaggccacacccacctctctccagcaaacacccccttgttctacccctccagctaccaccaactttcctgctctctggccgggttcgtgtgagccaggatgggcagtttctgcactacatctttccataccagttcatggactctcctgagtgggaatcactacagccttctgaggagggggtgttccaggtcactctgactgctgagacctcatgtagctacatttcctggccccggaaaagtctccatcttcttctgaccaaagagcgatacatctcctgcctcttctcggctctgctgggatatgacatctcggagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggggtgaggactccaccagtctggtgctggaggattttgaggaggtgtcaggatcagaatcgtttatggattataggagtgatggggagtacatgaggtgaagggagaactaacatgggcacagccaccggctcaggatcctatcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290666 - DNA, 1199 bp, Homo sapiens
atgtgtccagttaaaatctagcaccattaaggaagagaagaaagcagatactggagaacagactgccacactggatttcccagggttcgtgtgagccaggatgggcagtttctgcactacatctttccataccagttcatggactctcctgagtgggaatcactacagccttctgaggagggggtgttccaggtcactctgactgctgagacctcatgtagctacatttcctggccccgtctcggctctgctgggatatgacatctcggagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggggtgaggactccaccagtctggtgctggaggattttgaggaggtgtcaggatcagaatcgtttatggattataggagtgatggggagtacatgaggtgaagggagaactaacatgggcacagccaccggctcaggatcctatcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290667 - DNA, 664 bp, Homo sapiens
ttcggatccgaaacgaattctggcaccgaggtcccctcctcaggccacacccacctctctccagcaaacacccccttgttctacccctccagctaccaccaactttcctgcacctcctacccgggccaggttgtccaggccagacagtggcatactggcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290668 - DNA, 754 bp, Homo sapiens
aaagttgatctcttggtctctacaataggagaggattgggctagataccttcaaagctgacttgccctaatattctagtatgaaatgattcgaaggtacacctgcccctatcatgtcaggcagtgagtacagttaaaacattgggaattggtaaaggaaagaaaaaaactgaaaagaaccctttgaagttagacaaactgtccagagacatagtgctaaaatcctccctctttttctttccacagcttcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290669 - DNA, 1583 bp, Homo sapiens
tgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtgagtataggtgcttggagaggataaggaaatcaccctgatccaatagctggtaacctgcgaggcatatcatatctcatgactatggtaacttcaagcattacatcgtcacgcaactattcaagcctggatgaaaggtcactctgactgctgagacctcatgtagctacatttcctggccccggaaaagtctccatcttcttctgaccaaagagcgatacatctcctgcctcttctcggctctgctgggatatgacatctcggagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggggtgaggactccaccagtctggtgctggaggattttgaggaggtgtcaggatcagaatcgtttatggattataggagtgatggggagtacatgaggtgaagggagaactaacatgggcacagccaccggctcaggatcctatcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttcaaaaaagagagatcatatacccgatccatgcgtgtgaacgacgcgccaagtcagtaggtgaaatcgacccggaattcccagcagtacctgaggggatcacattccctatcagggtcgt

SEQ ID NO: 290670 - DNA, 1441 bp, Homo sapiens
tgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtgagtataggtgcttggagaggataaggaaatcaccctgatccaatagctggtaacctgcgaggcatatcatatctcatgactatggtaacttcaagcattacatcgtcacgcaactattcaagcctggatgaaaggtcactctgactgctgagacctcatgtagctacatttcctggccccggaaaagtctccatcttcttctgaccaaagagcgatacatctcctgcctcttctcggctctgctgggatatgacatctcggagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttcaaaaaagagagatcatatacccgatccatgcgtgtgaacgacgcgccaagtcagtaggtgaaatcgacccggaattcccagcagtacctgaggggatcacattccctatcagggtcgt

SEQ ID NO: 290671 - DNA, 1813 bp, Homo sapiens
  misc_feature (1676)..(1676): n is a, c, g, or t
tgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtgagtataggtgcttggagaggataaggaaatcaccctgatccaatagctggtaacctgcgaggcatatcatatctcatgactatggtaacttcaagcattacatcgtcacgcaactattcaagcctggatgaaaggtcactctgactgctgagacctcatgtagctacatttcctggccccggaaaagtctccatcttcttctgaccaaagagcgatacatctcctgcctcttctcggctctgctgggatatgacatctcggagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggggtgaggactccaccagtctggtgctggaggattttgaggaggtgtcaggatcagaatcgtttatggattataggagtgatggggagtacatgaggtgaagggagaactaacatgggcacagccaccggctcaggatcctatcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttcaaaaacaaaaaatcggcctgcgatggccctcaacgatggaagctcttgcggccgctttccctttaatggaggggcttaattcatcgacccttcgctcacttgcactccctcgcacttccggtcgtatcagtgtggcggaaaagacgttttcaagcttcacttcaataggcaggtaataacgtgtcttttcaactaaattctcggggtgttnacctaatatgataaaaacatcgttagtccataaagggcccagtaaataaggcctgagaacccggaataatgcgcctgtgtgagattggaatttatattattatgcattcgctccccttgacgagattcacatataat

SEQ ID NO: 290672 - DNA, 1237 bp, Homo sapiens
tgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtgagtataggtgcttggagaggataaggaaatcaccctgatccaatagctggtaacctgcgaggcatatcatatctcatgactatggtaacttcaagcattacatcgtcacgcaactattcaagcctggatgaaaggtcactctgactgctgagacctcatgtagctacatttcctggccccggaaaagtctccatcttcttctgaccaaagagcgatacatctcctgcctcttctcggctctgctgggatatgacatctcggagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggcttctagaattcctctccagagctactctcaagttatatccaggggacaggcccctttggctccaacccacacgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290673 - DNA, 1255 bp, Homo sapiens
tgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtgagtataggtgcttggagaggataaggaaatcaccctgatccaatagctggtaacctgcgaggcatatcatatctcatgactatggtaacttcaagcattacatcgtcacgcaactattcaagcctggatgaaaggtcactctgactgctgagacctcatgtagctacatttcctggccccggaaaagtctccatcttcttctgaccaaagagcgatacatctcctgcctcttctcggctctgctgggatatgacatctcggagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggggtgaggactccaccagtctggtgctggaggattttgaggaggtgtcaggatcagaatcgtttatggattataggagtgatggggagtacatgaggtgaagggagaactaacatgggcacagccaccggctcaggatcctatcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290674 - DNA, 344 bp, Homo sapiens
gttttagcccatttacgaatctcccctgcgcccgcagcaaacaactcacttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcatcggtaaacagtgggggttatgaaacccacctcacagggttgttgtgaggatccaatgagttgatttaggtaagcacctagcacatgccgtggcaccaagtaagcactcaataaatcactcaactcctttc

SEQ ID NO: 290675 - DNA, 2149 bp, Homo sapiens
  misc_feature (1)..(2): n is a, c, g, or t
  misc_feature (4)..(4): n is a, c, g, or t
  misc_feature (6)..(9): n is a, c, g, or t
nncncnnnncttccccttcccctcccagcgcgcccgcgcgccccgcggccctcggcgagcagctcggctccccccagcgctccccgggcccaaagatatggcaatggtagttagcagctggcgagatccgcaggacgacgtggccgggggcaaccccggcggccccaaccccgcagcgcaggcggcccgcggcggcggcggcggcgccggcgagcagcagcagcaggcgggctcgggcgcgccgcacacgccgcagaccccgggccagcccggagcgcccgccacccccggcacggcgggggacaagggccagggcccgcccggttcgggccagagccagcagcacatcgagtgcgtggtgtgcggggacaagtcgagcggcaagcactacggccaattcacctgcgagggctgcaaaagtttcttcaagaggagcgtccgcaggaacttaacttacacatgccgtgccaacaggaactgtcccatcgaccagcaccaccgcaaccagtgccaatactgccgcctcaagaagtgcctcaaagtgggcatgaggcgggaagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctagaccttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactcttttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcgaggctgttcttcaagaattaaaattgaagtgaaaatttaaacaaaaataaaagaatttagcaaaacccatgtgtct

SEQ ID NO: 290676 - DNA, 1824 bp, Homo sapiens
taccaaatcagtctatagaaaagtgcatatgctttctgctgcacgtgttcggccactacgtgtcggccacgtggccggacacgtagtggcggaccgtacacgtcccatcgatgaattcgagctcgaatcaggtacgtgtccggccgtggccggacacgtatcgaccagcaccaccgcaaccagtgccaatactgccgcctcaagaagtgcctcaaagtgggcatgaggcgggaagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctagaccttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactcttttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcgaggctgttcttcaagaattaaaattgaagtgaaaatttaaacaaaaataaaagaatttagcaaaacccatgtgtct

SEQ ID NO: 290677 - DNA, 1947 bp, Homo sapiens
  misc_feature (1)..(2): n is a, c, g, or t
  misc_feature (4)..(4): n is a, c, g, or t
  misc_feature (6)..(9): n is a, c, g, or t
  misc_feature (1931)..(1931): n is a, c, g, or t
nncncnnnncttccccttcccctcccagcgcgcccgcgcgccccgcggccctcggcgagcagctcggctccccccagcgctccccgggcccaaagatatggcaatggtagttagcagctggcgagatccgcaggacgacgtggccgggggcaaccccggcggccccaaccccgcagcgcaggcggcccgcggcggcggcggcggcgccggcgagcagcagcagcaggcgggctcgggcgcgccgcacacgccgcagaccccgggccagcccggagcgcccgccacccccggcacggcgggggacaagggccagggcccgcccggttcgggccagagccagcagcacatcgagtgcgtggtgtgcggggacaagtcgagcggcaagcactacggccaattcacctgcgagggctgcaaaagtttcttcaagaggagcgtccgcaggaacttaacttacacatgccgtgccaacaggaactgtcccatcgaccagcaccaccgcaaccagtgccaatactgccgcctcaagaagtgcctcaaagtgggcatgaggcgggaagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctagaccttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactcttttaggatcagatctgtgagcacgttggcgaggaaaaacaaaacaaacaaaaaaaagaaccttgtgtctgtctggtgaaaaaaagaaaaacaaattggaagagaggaccatgagaattttataaccagagaaactatggcttcggattatgtgacggcggtggctttttcgtcggacaccctttggagtggcgagccttgttaacccccccggctggttcctcggcacctcgcttttccttcgggactactcctgcctgaaaggagcgttgggggcgcctcccgattaagcgcggggtatattggggtttgccccccgcgcgtaaagtgacccttaggagggggcggcaaaaaaagggggcccgncatggtgttgtgtgcg

SEQ ID NO: 290678 - DNA, 1899 bp, Homo sapiens
  misc_feature (1)..(2): n is a, c, g, or t
  misc_feature (4)..(4): n is a, c, g, or t
  misc_feature (6)..(9): n is a, c, g, or t
nncncnnnncttccccttcccctcccagcgcgcccgcgcgccccgcggccctcggcgagcagctcggctccccccagcgctccccgggcccaaagatatggcaatggtagttagcagctggcgagatccgcaggacgacgtggccgggggcaaccccggcggccccaaccccgcagcgcaggcggcccgcggcggcggcggcggcgccggcgagcagcagcagcaggcgggctcgggcgcgccgcacacgccgcagaccccgggccagcccggagcgcccgccacccccggcacggcgggggacaagggccagggcccgcccggttcgggccagagccagcagcacatcgagtgcgtggtgtgcggggacaagtcgagcggcaagcactacggccaattcacctgcgagggctgcaaaagtttcttcaagaggagcgtccgcaggaacttaacttacacatgccgtgccaacaggaactgtcccatcgaccagcaccaccgcaaccagtgccaatactgccgcctcaagaagtgcctcaaagtgggcatgaggcgggaagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccatgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctagaccttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactcttttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcgaggctgttcttcaagaattaaaattgaagtgaaaatttaaacaaaaataaaagaatttagcaaaacccatgtgtct

SEQ ID NO: 290679 - DNA, 709 bp, Homo sapiens
agtttgttagtgggtttagaatagtagggccaggcaggctgggtgggagggaggagggccgagacaggagcagcccacccagcagaaatacaatccgagctacaaagcatgggaaaaagagactcttttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcgaggctgttcttcaagaattaaaattgaagtgaaaatttaaacaaaaataaaagaatttagcaaaacccatgtgtct

SEQ ID NO: 290680 - DNA, 774 bp, Homo sapiens
tgatatagtttaataaaaaccctagattgtgaatctagtaatagaaaattaaatattcttatctaccgaaaaaggttgcaagaactgctaactcatgcttccacacttaaaaatgtggctttttcaacttttaaagagcccacccagcagaaatacaatccgagctacaaagcatgggaaaaagagactcttttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcgaggctgttcttcaagaattaaaattgaagtgaaaatttaaacaaaaataaaagaatttagcaaaacccatgtgtct

SEQ ID NO: 290681 - DNA, 1700 bp, Homo sapiens
  misc_feature (1)..(2): n is a, c, g, or t
  misc_feature (4)..(4): n is a, c, g, or t
  misc_feature (6)..(9): n is a, c, g, or t
nncncnnnncttccccttcccctcccagcgcgcccgcgcgccccgcggccctcggcgagcagctcggctccccccagcgctccccgggcccaaagatatggcaatggtagttagcagctggcgagatccgcaggacgacgtggccgggggcaaccccggcggccccaaccccgcagcgcaggcggcccgcggcggcggcggcggcgccggcgagcagcagcagcaggcgggctcgggcgcgccgcacacgccgcagaccccgggccagcccggagcgcccgccacccccggcacggcgggggacaagggccagggcccgcccggttcgggccagagccagcagcacatcgagtgcgtggtgtgcggggacaagtcgagcggcaagcactacggccaattcacctgcgagggctgcaaaagtttcttcaagaggagcgtccgcaggaacttaacttacacatgccgtgccaacaggaactgtcccatcgaccagcaccaccgcaaccagtgccaatactgccgcctcaagaagtgcctcaaagtgggcatgaggcgggaagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctagaccttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactctggaacctacttgaaggtaaagtgtaggatgagggggaggagcagaaaaaataactattgggtattaggcttagcacttggtgatgaaataatctgtacaataaatccttgtgacatgggagtgagtaccgagct

SEQ ID NO: 290682 - DNA, 308 bp, Homo sapiens
  misc_feature (24)..(25): n is a, c, g, or t
cccccgggctgcaggaaatcggcnncgaggagagagagagagagagagagagagagagagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcgaggctgttcttcaagaattaaaattgaagtgaaaatttaaacaaaaataaaagaatttagcaaaacccatgtgtct

SEQ ID NO: 290683 - DNA, 1732 bp, Homo sapiens
agagctgttctagaggatcccaatgcagcggaatcggaacacatgccgtgccaacaggaactgtcccatcgaccagcaccaccgcaaccagtgccaatactgccgcctcaagaagtgcctcaaagtgggcatgaggcgggaagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctagaccttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactcttttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcgaggctgttcttcaagaattaaaattgaagtgaaaatttaaacaaaaataaaagaatttagcaaaacccatgtgtct

SEQ ID NO: 290684 - DNA, 1681 bp, Homo sapiens
cactgggcaaaagctggctgcaggttgcagtggcaccgcgcaggacagacattaattatatttcctacttttttcaataatgtttggctactcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctagaccttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactcttttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcgaggctgttcttcaagaattaaaattgaagtgaaaatttaaacaaaaataaaagaatttagcaaaacccatgtgtct

SEQ ID NO: 290685 - DNA, 1227 bp, Homo sapiens
gggatggagaggtataggagggtgaatttttcttttctcttttacttcttttttattttccattttctccttaaaaaaaattgatggcttattttgcctttgctatttgtcagcctaaccgtgtgctccctttccctgtctctccctcctgtggctgcttgggcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctagaccttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactcttttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcgaggctgttcttcaagaattaaaattgaagtgaaaatttaaacaaaaataaaagaatttagcaaaacccatgtgtct

SEQ ID NO: 290686 - DNA, 616 bp, Homo sapiens
gtggaaacattttatcagcaaaacgctgcttgcttgcaaatgaggaggccgctaggcatttgcctagaaccacaacctttctccggtttcgcctttttttaaccctgattttttttttccattctggaggggtgagtggggtttcatttatctgtgtgttcccccgtggtggcttaggggttggatgacactttcttgaccttgccagggttggggccctggagtcaggcctagctccggcggggctgacgtggccaggggctcaggcagtggctggacacactgagctgtggagctggagggcctcaccccagatctcctagcggtgtggactgtgagagcgagccggagaagatgcgcggggcgcgtgtggctgcgggaagagcttctgcattgtgttgggtacgctgcggcgcggcaatgttcgcaagctccctggatgcacattgcctcttttctctctttctttttgtcagcggttcagcgaggaagaatgcctccaacccagcccaatccaggccagtacgcactcaccaacggggaccccctcaacggccactgctacctgtccggctacatctcgctgctgctgcgcgccgagccctaccccacgtcg

SEQ ID NO: 290687 - DNA, 2751 bp, Homo sapiens
tttttttttgaggcaaggtctagctttgttgcccaggctggggtgcagtagcgcgatcgcagttcactgcaacctccgcctccctgactcgagcgattctcccacctcagcctctggagtgctgcgaccccaggcgccgccacctaattaatagacgcgttgcctccgtttttcaaatgtccctttcaggacgccgtccccttcctggtacgcgaagcgctgggagcgaaagggacttccgggagatctaggaagtcgcttctttttctggtagaaggcggggttctcctcgtacgctgcggagtctctgcggggtgtagaccggaatcctgctgacgggcagagtggatcagggagggagggtcgagacacggtggctgcaggtctgagacaaggctgctccgaggtagtagctctcttgcctggaggtggccattcattcctggagtgctgctgaggagcgagggcccatctggggtctctggaagtcggtgcccaggcctgaaggatagccccccttgcgcttccctgggctgcggccggccttctcagaacgaagggcgtccttccaccccgcggcgcaggtgaccgctgccatggcttttccccatcggccggacgcccctgagctgcctgacttctccatgctgaagaggctggctcgagaccagctcatctatctgctggagcagcttcctggaaaaaaggatttattcattgaggcagatctcatgagccctttggatcgaattgccaatgtctccatcctgaagcaacacgaagtagacaagctatacaaggtggagaacaagccagccctcagctccaatgaacaattgtgcttcttggtcagaccccgcatcaagaatatgcgatacattgccagtcttgtcaatgctgacaaattggctggccgaactcgcaaatacaaagtgatcttcagccctcaaaagttctatgcgtgtgagatggtgcttgaggaagagggaatctatggagatgtgagctgtgatgaatgggccttctctttgctgcctcttgatgtggatctgctgagcatggaactaccagaatttttcagggattactttctggaaggagatcagcgttggatcaacactgtagctcaggccttacaccttctcagcactctctatggaccctttccaaactgctatggaattggcaggtgcgccaagatggcatatgaattgtggaggaacctggaggaggaggaggatggcgaaaccaagggccgaaggccagagattggacatatctttctcttggacagagatgtggactttgtgacagcactttgctcccaagtggtttatgagggcctagtagatgacaccttccgcatcaagtgtgggagtgtcgactttggcccagaagtcacatcctctgacaagagcctgaaggtgctactcaatgccgaggacaaggtgtttaatgagattcggaacgagcacttctccaatgtctttggcttcttgagccagaaggcccggaacttgcaggcccagtatgatcgccggagaggcatggacattaagcagatgaagaatttcgtgtcccaggagctcaagggcctgaaacaggagcaccgcctgctgagtctccatattggggcctgtgaatccatcatgaagaagaaaaccaagcaggatttccaggagctaatcaagactgagcatgcactgctagaggggttcaacatccgggagagcaccagctacattgaggaacacatagaccggcaggtgtcgcctatagaaagcctgcgcctcatgtgccttttgtccatcactgagaatggtttgatccccaaggattaccgatctctgaaaacacagtatctgcagagctatggccctgagcacctgctaaccttctccaatctgcgaagagctgggctcctaacggagcaggcccccggggacaccctcacagccgtggagagtaaagtgagcaagctggtgaccgacaaggctgcaggaaagattactgatgccttcagttctctggccaagaggagcaattttcgtgccatcagcaaaaagctgaatttgatcccacgtgtggacggcgagtatgatctgaaagtgccccgagacatggcttacgtcttcggtggtgcttatgtgcccctgagctgccgaatcattgagcaggtgctagagcggcgaagctggcagggccttgatgaggtggtacggctgctcaactgcagtgactttgcattcacagatatgactaaggaagacaaggcttccagtgagtccctgcgcctcatcttggtggtgttcttgggtggttgtacattctctgagatctcagccctccggttcctgggcagagagaaaggctacaggttcattttcctgacgacagcagtcacaaacagcgctcgccttatggaggccatgagtgaggtgaaagcctgatgtttttcccggccagtgttgacatcttccctgaacacattcctcagtgagatgcaggcatctggcacccagctgctataaccaagtgtccaccaactacctgctaagagccgggagcatggaacgtgttgggatttagagaacattatctgagaaaagagttcacttcctgctcccaggatatttctcttttctgtttatgaagtacaacccatgctgctaagatgcgagcaggaagaggcatcctttgctaaatcctgtttgaatgtcattgtaaataaagcctctgctctcagatgta

SEQ ID NO: 290688 - DNA, 957 bp, Homo sapiens
tgggcaacaatagcaaaactccatctcaagagaaaaaaaaaaaacacgcaaagtgtcctgcacaggaatatttttctcctggcctcagaatacaacttgccatagccttaactctgggctgccacagcagggagcccagttataccagtcatagaaagcagtggtgcccaagagcatggcactcacgtctctgtctataaactggtgctgtgatcccgtggggactgtggaactggagaggctctatgggttgccgttggggcctaagatctgtgctgtctcttctgctgctgcatttgactccttaggctacaggttcattttcctgacgacagcagtcacaaacagcgctcgccttatggaggccatgagtgaggtgaaagcctgatgtttttcccggccagtgttgacatcttccctgaacacattcctcagtgagatgcaggcatctggcacccagctgctataaccaagtgtccaccaactacctgctaagagccgggagcatggaacgtgttgggatttagagaacattatctgagaaaagagttcacttcctgctcccaggatatttctcttttctgtttatgaagtacaacccatgctgctaagatgcgagcaggaagaggcatcctttgctaaatcctgtttgaatgtcattgtaaataaagcctctgctctcagatgtaatacgttggtcgttctggacacgcacttccatctttattagtgaaagcccattggagcttgctacaggggcttcctgtgcttcttggcctggactttgtagtggctccaggcctggtctggttcttccctgtaaaaatcactctaccactctgtacctgagtttcctctaccataaaatgagggagatggctgaggtgaccagcaagcacgtttccagttctaaaatgttgtgattcattacatttttgagaaaatgaaattgttgtt

SEQ ID NO: 290689 - DNA, 689 bp, Homo sapiens
tgggcaacaatagcaaaactccatctcaagagaaaaaaaaaaaacacgcaaagtgtcctgcacaggaatatttttctcctggcctcagaatacaacttgccatagccttaactctgggctgccacagcagggagcccagttataccagtcatagaaagcagtggtgcccaagagcatggcactcacgtctctgtctataaactggtgctgtgatcccgtggggactgtggaactggagaggctctatgggttgccgttggggcctaagatctgtgctgtctcttctgctgctgcatttgactccttaggctacaggttcattttcctgacgacagcagtcacaaacagcgctcgccttatggaggccatgagtgaggtgaaagcctgatgtttttcccggccagtgttgacatcttccctgaacacattcctcagtgagatgcaggcatctggcacccagctgctataaccaagtgtccaccaactacctgctaagagccgggagcatggaacgtgttgggatttagagaacattatctgagaaaagagttcacttcctgctcccaggatatttctcttttctgtttatgaagtacaacccatgctgctaagatgcgagcaggaagaggcatcctttgctaaatcctgtttgaatgtcattgtaaataaagcctctgctctcagatgta

SEQ ID NO: 290690 - DNA, 634 bp, Homo sapiens
caaccatatcctgtgtcacttaagggcagggaaaggagaagccatccctccagcccctttacattattcaataatggcgcatgggaactcattccagagaactggcagttactgaacaaaaactgccatcttccgttatggattctcttttcagggctattgctggttctccctttagttgaaataagaattgttccttgggccatgccactttatctgaccctttaaagggttagggagctgagctgtcacttgcctaatgaagtccctttgtcttacagatcccacgtgtggacggcgagtatgatctgaaagtgccccgagacatggcttacgtcttcggtggtgcttatgtgcccctgagctgccgaatcattgagcaggtgctagagcggcgaagctggcagggccttgatgaggtggtacggctgctcaactgcagtgactttgcattcacagatatgactaaggaagacaaggcttccagtgagtccctgcgcctcatcttggtggtgttcttgggtggttgtacattctctgagatctcagccctccggttcctgggcagagagaaaggtaagagagagcagaaaggtgagaattggcctgcattgtatctgggtaacaaagtgtc

SEQ ID NO: 290691 - DNA, 546 bp, Homo sapiens
agacaaggtttccccatgttggccaggctggttgatctgtacattttagggtgcctctgccggcctctttctcatgcacctgtcttattttcttcactcttaggtttgatccccaaggattaccgatctctgaaaacacagtatctgcaggtaaggcctggagaatgtattcttgagggaacttgatggagggcagttattgggcatttttgaaagaggcaagagaagtggcccctttcctgcctccattaccctcctgtttccattcaggcctccctcttagagctactagggagagtcacctttcagcacgcctctctgccctctacccttgtttcaccccacacactgacggcgcatggccagtgctgagaatttaaacatttcagtgctggccccagtgtgagttctttctcctgggagtctccctcattttagcaccgtgtgaggcattgattcagctttccttcctggtacttctcaagtcttacttcatccaggaagcctttcccatacatccatgggtctctaaagtctcatgctgct

SEQ ID NO: 290692 - DNA, 3019 bp, Homo sapiens
tttttttttgaggcaaggtctagctttgttgcccaggctggggtgcagtagcgcgatcgcagttcactgcaacctccgcctccctgactcgagcgattctcccacctcagcctctggagtgctgcgaccccaggcgccgccacctaattaatagacgcgttgcctccgtttttcaaatgtccctttcaggacgccgtccccttcctggtacgcgaagcgctgggagcgaaagggacttccgggagatctaggaagtcgcttctttttctggtagaaggcggggttctcctcgtacgctgcggagtctctgcggggtgtagaccggaatcctgctgacgggcagagtggatcagggagggagggtcgagacacggtggctgcaggtctgagacaaggctgctccgaggtagtagctctcttgcctggaggtggccattcattcctggagtgctgctgaggagcgagggcccatctggggtctctggaagtcggtgcccaggcctgaaggatagccccccttgcgcttccctgggctgcggccggccttctcagaacgaagggcgtccttccaccccgcggcgcaggtgaccgctgccatggcttttccccatcggccggacgcccctgagctgcctgacttctccatgctgaagaggctggctcgagaccagctcatctatctgctggagcagcttcctggaaaaaaggatttattcattgaggcagatctcatgagccctttggatcgaattgccaatgtctccatcctgaagcaacacgaagtagacaagctatacaaggtggagaacaagccagccctcagctccaatgaacaattgtgcttcttggtcagaccccgcatcaagaatatgcgatacattgccagtcttgtcaatgctgacaaattggctggccgaactcgcaaatacaaagtgatcttcagccctcaaaagttctatgcgtgtgagatggtgcttgaggaagagggaatctatggagatgtgagctgtgatgaatgggccttctctttgctgcctcttgatgtggatctgctgagcatggaactaccagaatttttcagggattactttctggaaggagatcagcgttggatcaacactgtagctcaggccttacaccttctcagcactctctatggaccctttccaaactgctatggaattggcaggtgcgccaagatggcatatgaattgtggaggaacctggaggaggaggaggatggcgaaaccaagggccgaaggccagagattggacatatctttctcttggacagagatgtggactttgtgacagcactttgctcccaagtggtttatgagggcctagtagatgacaccttccgcatcaagtgtgggagtgtcgactttggcccagaagtcacatcctctgacaagagcctgaaggtgctactcaatgccgaggacaaggtgtttaatgagattcggaacgagcacttctccaatgtctttggcttcttgagccagaaggcccggaacttgcaggcccagtatgatcgccggagaggcatggacattaagcagatgaagaatttcgtgtcccaggagctcaagggcctgaaacaggagcaccgcctgctgagtctccatattggggcctgtgaatccatcatgaagaagaaaaccaagcaggatttccaggagctaatcaagactgagcatgcactgctagaggggttcaacatccgggagagcaccagctacattgaggaacacatagaccggcaggtgtcgcctatagaaagcctgcgcctcatgtgccttttgtccatcactgagaatggtttgatccccaaggattaccgatctctgaaaacacagtatctgcagagctatggccctgagcacctgctaaccttctccaatctgcgaagagctgggctcctaacggagcaggcccccggggacaccctcacagccgtggagagtaaagtgagcaagctggtgaccgacaaggctgcaggaaagattactgatgccttcagttctctggccaagaggagcaattttcgtgccatcagcaaaaagctgaatttgatcccacgtgtggacggcgagtatgatctgaaagtgccccgagacatggcttacgtcttcggtggtgcttatgtgcccctgagctgccgaatcattgagcaggtgctagagcggcgaagctggcagggccttgatgaggtggtacggctgctcaactgcagtgactttgcattcacagatatgactaaggaagacaaggcttccagtgagtccctgcgcctcatcttggtggtgttcttgggtggttgtacattctctgagatctcagccctccggttcctgggcagagagaaaggctacaggttcattttcctgacgacagcagtcacaaacagcgctcgccttatggaggccatgagtgaggtgaaagcctgatgtttttcccggccagtgttgacatcttccctgaacacattcctcagtgagatgcaggcatctggcacccagctgctataaccaagtgtccaccaactacctgctaagagccgggagcatggaacgtgttgggatttagagaacattatctgagaaaagagttcacttcctgctcccaggatatttctcttttctgtttatgaagtacaacccatgctgctaagatgcgagcaggaagaggcatcctttgctaaatcctgtttgaatgtcattgtaaataaagcctctgctctcagatgtaatacgttggtcgttctggacacgcacttccatctttattagtgaaagcccattggagcttgctacaggggcttcctgtgcttcttggcctggactttgtagtggctccaggcctggtctggttcttccctgtaaaaatcactctaccactctgtacctgagtttcctctaccataaaatgagggagatggctgaggtgaccagcaagcacgtttccagttctaaaatgttgtgattcattacatttttgagaaaatgaaattgttgtt

SEQ ID NO: 290693 - DNA, 2558 bp, Homo sapiens
tttttttttgaggcaaggtctagctttgttgcccaggctggggtgcagtagcgcgatcgcagttcactgcaacctccgcctccctgactcgagcgattctcccacctcagcctctggagtgctgcgaccccaggcgccgccacctaattaatagacgcgttgcctccgtttttcaaatgtccctttcaggacgccgtccccttcctggtacgcgaagcgctgggagcgaaagggacttccgggagatctaggaagtcgcttctttttctggtagaaggcggggttctcctcgtacgctgcggagtctctgcggggtgtagaccggaatcctgctgacgggcagagtggatcagggagggagggtcgagacacggtggctgcaggtctgagacaaggctgctccgaggtagtagctctcttgcctggaggtggccattcattcctggagtgctgctgaggagcgagggcccatctggggtctctggaagtcggtgcccaggcctgaaggatagccccccttgcgcttccctgggctgcggccggccttctcagaacgaagggcgtccttccaccccgcggcgcaggtgaccgctgccatggcttttccccatcggccggacgcccctgagctgcctgacttctccatgctgaagaggctggctcgagaccagctcatctatctgctggagcagcttcctggaaaaaaggatttattcattgaggcagatctcatgagccctttggatcgaattgccaatgtctccatcctgaagcaacacgaagtagacaagctatacaaggtggagaacaagccagccctcagctccaatgaacaattgtgcttcttggtcagaccccgcatcaagaatatgcgatacattgccagtcttgtcaatgctgacaaattggctggccgaactcgcaaatacaaagtgatcttcagccctcaaaagttctatgcgtgtgagatggtgcttgaggaagagggaatctatggagatgtgagctgtgatgaatgggccttctctttgctgcctcttgatgtggatctgctgagcatggaactaccagaatttttcagggattactttctggaaggagatcagcgttggatcaacactgtagctcaggccttacaccttctcagcactctctatggaccctttccaaactgctatggaattggcaggtgcgccaagatggcatatgaattgtggaggaacctggaggaggaggaggatggcgaaaccaagggccgaaggccagagattggacatatctttctcttggacagagatgtggactttgtgacagcactttgctcccaagtggtttatgagggcctagtagatgacaccttccgcatcaagtgtgggagtgtcgactttggcccagaagtcacatcctctgacaagagcctgaaggtgctactcaatgccgaggacaaggtgtttaatgagattcggaacgagcacttctccaatgtctttggcttcttgagccagaaggcccggaacttgcaggcccagtatgatcgccggagaggcatggacattaagcagatgaagaatttcgtgtcccaggagctcaagggcctgaaacaggagcaccgcctgctgagtctccatattggggcctgtgaatccatcatgaagaagaaaaccaagcaggatttccaggagctaatcaagactgagcatgcactgctagaggggttcaacatccgggagagcaccagctacattgaggaacacatagaccggcaggtgtcgcctatagaaagcctgcgcctcatgtgccttttgtccatcactgagaatggtttgatccccaaggattaccgatctctgaaaacacagtatctgcagagctatggccctgagcacctgctaaccttctccaatctgcgaagagctgggctcctaacggagcaggcccccggggacaccctcacagccgtggagagtaaagtgagcaagctggtgaccgacaaggctgcaggaaagattactgatgccttcagttctctggccaagaggagcaattttcgtgccatcagcaaaaagctgaatttgatcccacgtgtggacggcgagtatgatctgaaagtgccccgagacatggcttacgtcttcggtggtgcttatgtgcccctgagctgccgaatcattgagcaggctacaggttcattttcctgacgacagcagtcacaaacagcgctcgccttatggaggccatgagtgaggtgaaagcctgatgtttttcccggccagtgttgacatcttccctgaacacattcctcagtgagatgcaggcatctggcacccagctgctataaccaagtgtccaccaactacctgctaagagccgggagcatggaacgtgttgggatttagagaacattatctgagaaaagagttcacttcctgctcccaggatatttctcttttctgtttatgaagtacaacccatgctgctaagatgcgagcaggaagaggcatcctttgctaaatcctgtttgaatgtcattgtaaataaagcctctgctctcagatgta

SEQ ID NO: 290694 - DNA, 957 bp, Homo sapiens
caaccatatcctgtgtcacttaagggcagggaaaggagaagccatccctccagcccctttacattattcaataatggcgcatgggaactcattccagagaactggcagttactgaacaaaaactgccatcttccgttatggattctcttttcagggctattgctggttctccctttagttgaaataagaattgttccttgggccatgccactttatctgaccctttaaagggttagggagctgagctgtcacttgcctaatgaagtccctttgtcttacagatcccacgtgtggacggcgagtatgatctgaaagtgccccgagacatggcttacgtcttcggtggtgcttatgtgcccctgagctgccgaatcattgagcaggtgctagagcggcgaagctggcagggccttgatgaggtggtacggctgctcaactgcagtgactttgcattcacagatatgactaaggaagacaaggcttccagtgagtccctgcgcctcatcttggtggtgttcttgggtggttgtacattctctgagatctcagccctccggttcctgggcagagagaaaggctacaggttcattttcctgacgacagcagtcacaaacagcgctcgccttatggaggccatgagtgaggtgaaagcctgatgtttttcccggccagtgttgacatcttccctgaacacattcctcagtgagatgcaggcatctggcacccagctgctataaccaagtgtccaccaactacctgctaagagccgggagcatggaacgtgttgggatttagagaacattatctgagaaaagagttcacttcctgctcccaggatatttctcttttctgtttatgaagtacaacccatgctgctaagatgcgagcaggaagaggcatcctttgctaaatcctgtttgaatgtcattgtaaataaagcctctgctctcagatgta

SEQ ID NO: 290695 - DNA, 2549 bp, Homo sapiens
gaagggtaatggaaacctggtacagcctttagaagttggaagctatggtggtgtatctgtcatgaactgcacacaagggaatgcttaaacaccagctgagtcatatcaggtgccttgtacacacacataaagagtctggtgaattctgacagtgttctgtttgccactagagcaaatttaatagctggggtttcacagcaactgttttagaaaactatatgtgccaaaaatttacattgggcagcagtttatagtgttcttggccaatctgcataaaagccacttgaggaggtttgattaagaaaattgtgtttatctcctgtattacctctgtgtttgatttattctttagtctcaaatttattttctgagtggactgattttctatatgaactgaaatgatgttttaatagaataataggtatttttagaggaaaagtatttttttgtgtaatttgcttacacaactaggacatacttcctatgatactgaatcatcaaattgagtcatttaaagctgaaagaggtgttaggaatgtagtttcacattatttaaatacatgaacagttttctatatattttgtgaaaatcttgatgagacactagaatttctttatggaattgaactttacaagaattttaataaaagaggtggatttcttcagctttctttgtgcttcagtttcatagctgaaaatgctgcttccgtttattaatatggactttgtaaggaaacacaacaacacgttttcttaccttctgtaaattttgtgatagacacatgttatttgtatatatgattgattgtttgcctgttgcaccctaaagttattttcaaaccatgtttattgcaaagagagcctttgggcaagtggaaaatgccctgatgctagaatgaggtagttccataagctagttaggagcttgctacctcttcttggtacctgaaatattctgaaaggatatcggagaggtcctatgcacccctgtctttcaaaacccacctccagcacttcaaagtagtgtctctggagagtttaaaataaaagaatgaatgctattcagtggattccctcattgaggctcccatctttcctgccaggtgcagctttttctggttggaatcatctcttctttacggattgccgcattgtctctttgtgaatgaggcaggctgaactgtagagcatgaaactcattagaagtttataaagtaaagacctgtaaagcatgtgggtggaatgtttccatgctcttgaggtgaatattaaatttaaattctggcctttgggaactctttgcttgtgagctgaagaaggaaagaaggagttgggggtgtatatctaactgtgtttttctatatggaaatatatgagcatcaagtgataacttcaataaggcctcaggattgtatttaaaatacctgttttgtgggacagcatgcctttgttttctttgcctgttggctttggtggctccaaacattttcattttaggctagctttcctgtcacccaggttgtgtgcattttttttttcatttgaactattgtttatcattattaatgatgttatctccaaatcccaaagccaaggaaatagccagtatgcaggacttgcagtagatataagcattggtgttaacataggttaagttttgttagtgttcccagaaatatactgaattgagggataatgtagctttaaagaaattatgtttctttttaacatttggagaagccacctgtcctgggtccctattcttgagaaattcatcttttcatgcaaataacattgatgggggacaagactggatgattgacttctatcagtcagtagacaaggaagtataataattgccaaaggtgagggtaattttgccttacaagtatgtaggtcattctgtggtgggatttcccatcacatctagtaaaaaacaaccttttcatttccctcctttctaatccaagatcatatttttaaaaagtaggtttctgatgtgccatgaaatatttctgtgaatctgtgtttttgaccaaggaaacagctgagatattaaaccatgtggttgttccacggttcatctggctaccgttctgggtcccctctgaccacctcaaaaagaaaatgaaattgggagattaaatcaagcttgacctcctcttttaatgaggaactttcacgttgacttcctatctcaggatattcttcagtttcatactgctgaggagaaaggaacaagctgcagacactgtaactggtctccagatgtgtgtatatgcgtgtaaaacttcacaccgtgtgtgttgtgttcaatgttgtgtcaatctacaaactgactcaaacaacagtttaacgatagagaagacagtgataatggcaaaaaaaacacccaaccacctttttccgtcaaagtgcttgctatggctttcatagctgggacaagtaacattaagtattcaggagcaaagtgttcttgaaagaaaatggtgtgttgatctcataagaaaatgtacaaccaataaaagacattttaaaaagaaaaatga

SEQ ID NO: 290696 - DNA, 541 bp, Homo sapiens
cttcctttaaccttaaaaacaaagtcacatttataatattgaatatttcttcattgctcctccagttgtttgtaattgctaattttcatattgccttcagctcatctaatctatttgagactctactttaaatttcttattgttaagaaagtaaaatattaatatgatttagaaatggaatatcagggtaaaggaagaagcaagatagttcagtcttctgaatacccagaatccataattttgtaggtctgcctagtactgtgttaactactgtgaggtatgaaaaattaacatagtagggtatagtagcagagataaaacttgaattttaatcaatataaaaataaagttaacaagaaattgttaaatcctggccatacattttattaagcttcacttatcagaaacaaaatgaaataaaacaatagtaaaaagcttgtagcgtgcctggctcatgaagaaaattcagtgtagctgactgctttaacatcttgccttgttatttcaagaaaaaggtgacttgtatcaagttaatcaatgt

SEQ ID NO: 290697 - DNA, 609 bp, Homo sapiens
caggaacaaagctatacactatttcgaattttaatacggactcactaaagggaatttgccctcaagggcaaagaattggccacaaggaaagtgaaaaaaaaaaaaaaaacgtctagatcacctttgaggatgtgaaagatgctgtctaggcaaacttctggatcaagaatcctgtccagactagtcttcctgatctttagatgcttatgtgtcagcacctccaataggcaatagtattttctattgatataaagttcaaacctcagctagaatttttgtttctcttattcaaattcttaactttcaagaccttaactgtgaagtttaagcttaaacagcaattcttaatgtttttaagagtttaagaaaagttaccatgcccagtacaaactgtagcaaactacgatgcaaatatggctcatggtaattttatggtacagtataatttcaggcaattaaattcaaagcttagaaatggaatagatgtgggagattaccagttgtgaactgaaggagaccacagaatcaacagtgttagtgtaagcatttattattactactaatgacaatactcactgataagtccagtttgtgaacatttaaaaaaaa

SEQ ID NO: 290698 - DNA, 465 bp, Homo sapiens
taagttccaaccccgctggctcagagagggatctcctggccacttcctcctcctgcccagccccattctgctcaccttctcagaccttctgagaaaggccaccctgttttccaaaccccagatgagcacacgagatctgatgtgttctagtactccctgagtgttgaagtcttgtatcagaaaaattttgcaaaatcagattaccttttgtaggtgctttaacccattgcctttatggcaaaggatgaaattatagtgaaatcgggagctgatgtgatgctggcaggagccaagggagctgtattgatatggtttcgtttctctttcagtagaatattgggattagaattgatatgaatattattgtaattgattatgatttgagaggtttctaattggttgcattaacttcagaggctctgtaactttccgttttccttcatcaaaagtttctttccctcttct

SEQ ID NO: 290699 - DNA, 642 bp, Homo sapiens
gctgaagtgaaaacgagaccaaggtctagctctactgttggtacttatgagatccagtcctggcaacatggagaggattgtcatctgtctgatggtcatcttcttggggacactggtccacaaatcaagctcccaaggtcaagatcgccacatgattagaatgcgtcaacttatagatattgttgatcagctgaaaaattatgtgaatgacttggtccctgaatttctgccagctccagaagatgtagagacaaactgtgagtggtcagctttttcctgttttcagaaggcccaactaaagtcagcaaatacaggaaacaatgaaaggataatcaatgtatcaattaaaaagctgaagaggaaaccaccttccacaaatgcagggagaagacagaaacacagactaacatgcccttcatgtgattcttatgagaaaaaaccacccaaagaattcctagaaagattcaaatcacttctccaaaagatgattcatcagcatctgtcctctagaacacacggaagtgaagattcctgaggatctaacttgcagttggacactatgttacatactctaatatagtagtgaaagtcatttctttgtattccaagtggaggagccctattaaattatataaagaaata

SEQ ID NO: 290700 - DNA, 3787 bp, Homo sapiens
gttggcagtaatgctgccctgttattctttactccgctgagatgttgggtggagagaaacataaatctggcctacgtgcacgtccaggcatactaccttcccttgaacttaatgatgatatagattgctttgctcatatgttttttggtgtgaccttctctttattatcactcctgctctccgtactacattcctttatgctgaaataattgaaaatcatatatcaattataagatgaagtggaactcacgatggccgtgatgccggtgcgtggtccttgggtgtagctgagtgccggtcccctggtactccactattgtgtctccctcaaagattatataaaaaaatacaacaatacttaaacaaaatgaatgtacctcacaaatacaattcacaggagtgtatccagaagaaggtaccaaagaagctagagagcctgagaggataaacatgacagatcatataagagtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagaccctagctaacatattatggagagaagaaggtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagacatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaaaaaccctacgatacaattattgaatgaagcgttttacaatacattgcacttaatccattgtttaaatttacaacttaactttccaagtttatatcctagtcaaacaaaatttacttggttggtccaaataaaataaattgtttttgactaagtgactaagacatacacaattaattatattggttaattagaaatactcagcacaatatttaatgagaaatcacatcagtcacaagaatcaaatatgtaaattatgctttaaacaataaagtaggatttaaatcatttaaaaaactaaactgcagggaatttcagatgacataaagcattatttcattttgagggtagtttattttttttctctgtccttttggtatgattaaacaagaaataaaaggtgttgtggaaacttaaaattcttaattcaaaatattcggtcctgtccactgtttataatattttgtgccttgaagggaatgtcacaggaggaaaaggaagactaaagcctgcatactaaatgctctcataactataaatctcttgttgttaaaaaacatctcttgcaccaaatcctgtcttcagtcttttgtttaaccctcaatgaactaccaattgaaggcataagttggtcttaggttgtatacaggtgtcaaactccacttgacatttactgtataatctgcagcatgctatagaaagtggggaggaagggaggaaaaataattacagtcaaaatatttgcaatctatctactcattttgctttcaatcactagagtgcattatgtttttaatgcaagtttgtctgggatgtcaactgcctacagatgtttattactagcagaatagattatttattaatagattgtttcttttcatatagtccaatgtttcatcatcaggaactttcggttttaaaaaagaaacattacttttgtctgctaaagtaaaccatatatagggaaattaacacctaggaaaagaaaactggcaagagaattgatgaggtattagtggcttagaagaattagtaatataagttgggaataaaggggtagcccgacagtggtaagtaaaaatgtagtactccattgtttttgctatttaaatataatgtatcaaaaacctttattctaaaatttccacaaatgattccttttatccatcttcttgtaatcctaaaagcatcttctcactatgtgctgtagtttgaaacctaacgaatcctcctacttgagacactgtagaaaagtaaaaattgttgcttctgttttgttttaagaggaaatgagaaggccagcagaagtagattaaaactagagagctggtttattaaaataagcagataattatccaggcttaaagtaatagcttacatgttttgaaaatccttgtacttatttttgtttttattgttgcaaaaaaatgttaatgggctgttgaaatgacctccatttacttaaggtaatccaataaggtcttttttaaatatacaaattttactcaagtttaaattgtataaaactgcttagaaacctgaaattttatagtgtgtaatatcttatgtgtatatagcatcctgagctgtgtgatacagtagatttcttcttagcagaaacatgcgaggtagatttaataaacaacaaaaatcagcttatgtttctacttattgaatctgctttactttttagcaattttcttccttgtgaacatgaaccatataaagtgtctgtgacttaatgatttcatgtaagtctgtcgcatacatccttcttttgtagcttacaccatgtggatgctctgtctgtagacactgcttgataaaaggagaataaacctcttacattttaacccttga

SEQ ID NO: 290701 - DNA, 2248 bp, Homo sapiens
agctcctgcctagggaggaggagcgagaatcagcctggttcagtgactgagacaaactggaggtgaaaggagctggtactgtccactgtgctgtcggtgctgaacctgagacgcgagcggaccagttgctccagcacctgaaggcaacgccctcttgcaccctctgtgccctgtgggacccgcttcaccaacaggacccatatcaacttgacaaaggagtgtggtatcggacgtgggagagagtcctctgtttgccacctgggcgctcattcaggcgtgactttggagatttctatagttttagaccaaactatttttttttccccagctaagacgatcttttgagagttttttttttttattgtgatttatatttccacagcgtttaggaatctttctgggggacttttgtgactgttaaaataaggtgaaaagcaataaggatgtttaagtgctggtcagttgtcttggttctcggattcatttttctggagtcggaaggaaggccaaccaaagaaggaggatatggccttaaatcctatcagcctctaatgagattgcgacataagcaggaaaaaaatcaagaaagttcaagagtcaaaggatttatgattcaggatggcccttttggatcttgtgaaaataagtactgtggtttgggaagacactgtgttaccagcagagagacagggcaagcagaatgtgcctgtatggacctttgcaaacgtcactacaaacctgtgtgtggatctgacggagaattctatgaaaaccactgtgaagtgcacagagctgcttgcctgaaaaaacaaaagattaccattgttcacaatgaagactgcttctttaaaggagataagtgcaagactactgaatacagcaagatgaaaaatatgctattagatttacaaaatcaaaaatatattatgcaagaaaatgaaaatcctaatggcgacgacatatctcggaagaagctattggtggatcaaatgtttaaatattttgatgcagacagtaatggacttgtagatattaatgaactaactcaggtgataaaacaggaagaacttggcaaggatctctttgattgtactttgtatgttctattgaaatatgatgattttaatgctgacaagcacctggctcttgaagaattttatagagcattccaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagaccctagctaacatattatggagagaagaaggtctgggaattgggaacatgttctatgttttttatgaagatggaatcaaagtgatacaacccatagaatgtgaatttcagaggcacattaagcctagtgaaaagctccttggatttcagttgtacacatgatttcatcttgtcacctggagtatgaacttcaagcaaatagaattctatttcagacttatggattcagaagtcaaactgaaaaggagtttggaaaaatgtttaaaattacaggctcaaaaacaagctttcccaagattaccaactttgtcactcttctggttttctactactgttccatccttatctatcactcttttattctttgatacttttacattcagccaccttctttgcttgttatagatctagctgctgcttttcacatatgccatggtattacttattatttaatgggtcctaaaataactttaaagaaaaccacgtgtcttattatg

SEQ ID NO: 290702 - DNA, 474 bp, Homo sapiens
gagataagtgcaagactactgaatacagcaagatgaaaaatatgctattagatttacaaaatcaaaaatatattatgcaagaaaatgaaaatcctaatggcgacgacatatctcggaagaagctattggtggatcaaatgtttaaatattttgatgcagacagtaatggacttgtagatattaatgaactaactcaggtatgattagtgactatattaacaaacttactgaaatatagcatgcacaatatatttactttttctaaatttactctataatgaaaaaatgtatatttgatccatattattgaaaagtatatgaataacaacatttttgtagcaaacttgactacatcatcagcaatattaatttcaagtaacatttatatggtgtttgacagtttaaaaagagatatctacttctgatagatatctatatcttaaatacctaaaggaattacaagttctttatctt

SEQ ID NO: 290703 - DNA, 4844 bp, Homo sapiens
agctcctgcctagggaggaggagcgagaatcagcctggttcagtgactgagacaaactggaggtgaaaggagctggtactgtccactgtgctgtcggtgctgaacctgagacgcgagcggaccagttgctccagcacctgaaggcaacgccctcttgcaccctctgtgccctgtgggacccgcttcaccaacaggacccatatcaacttgacaaaggagtgtggtatcggacgtgggagagagtcctctgtttgccacctgggcgctcattcaggcgtgactttggagatttctatagttttagaccaaactatttttttttccccagctaagacgatcttttgagagttttttttttttattgtgatttatatttccacagcgtttaggaatctttctgggggacttttgtgactgttaaaataaggtgaaaagcaataaggatgtttaagtgctggtcagttgtcttggttctcggattcatttttctggagtcggaaggaaggccaaccaaagaaggaggatatggccttaaatcctatcagcctctaatgagattgcgacataagcaggaaaaaaatcaagaaagttcaagagtcaaaggatttatgattcaggatggcccttttggatcttgtgaaaataagtactgtggtttgggaagacactgtgttaccagcagagagacagggcaagcagaatgtgcctgtatggacctttgcaaacgtcactacaaacctgtgtgtggatctgacggagaattctatgaaaaccactgtgaagtgcacagagctgcttgcctgaaaaaacaaaagattaccattgttcacaatgaagactgcttctttaaaggagataagtgcaagactactgaatacagcaagatgaaaaatatgctattagatttacaaaatcaaaaatatattatgcaagaaaatgaaaatcctaatggcgacgacatatctcggaagaagctattggtggatcaaatgtttaaatattttgatgcagacagtaatggacttgtagatattaatgaactaactcaggtgataaaacaggaagaacttggcaaggatctctttgattgtactttgtatgttctattgaaatatgatgattttaatgctgacaagcacctggctcttgaagaattttatagagcattccaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagaccctagctaacatattatggagagaagaaggtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagacatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaaaaaccctacgatacaattattgaatgaagcgttttacaatacattgcacttaatccattgtttaaatttacaacttaactttccaagtttatatcctagtcaaacaaaatttacttggttggtccaaataaaataaattgtttttgactaagtgactaagacatacacaattaattatattggttaattagaaatactcagcacaatatttaatgagaaatcacatcagtcacaagaatcaaatatgtaaattatgctttaaacaataaagtaggatttaaatcatttaaaaaactaaactgcagggaatttcagatgacataaagcattatttcattttgagggtagtttattttttttctctgtccttttggtatgattaaacaagaaataaaaggtgttgtggaaacttaaaattcttaattcaaaatattcggtcctgtccactgtttataatattttgtgccttgaagggaatgtcacaggaggaaaaggaagactaaagcctgcatactaaatgctctcataactataaatctcttgttgttaaaaaacatctcttgcaccaaatcctgtcttcagtcttttgtttaaccctcaatgaactaccaattgaaggcataagttggtcttaggttgtatacaggtgtcaaactccacttgacatttactgtataatctgcagcatgctatagaaagtggggaggaagggaggaaaaataattacagtcaaaatatttgcaatctatctactcattttgctttcaatcactagagtgcattatgtttttaatgcaagtttgtctgggatgtcaactgcctacagatgtttattactagcagaatagattatttattaatagattgtttcttttcatatagtccaatgtttcatcatcaggaactttcggttttaaaaaagaaacattacttttgtctgctaaagtaaaccatatatagggaaattaacacctaggaaaagaaaactggcaagagaattgatgaggtattagtggcttagaagaattagtaatataagttgggaataaaggggtagcccgacagtggtaagtaaaaatgtagtactccattgtttttgctatttaaatataatgtatcaaaaacctttattctaaaatttccacaaatgattccttttatccatcttcttgtaatcctaaaagcatcttctcactatgtgctgtagtttgaaacctaacgaatcctcctacttgagacactgtagaaaagtaaaaattgttgcttctgttttgttttaagaggaaatgagaaggccagcagaagtagattaaaactagagagctggtttattaaaataagcagataattatccaggcttaaagtaatagcttacatgttttgaaaatccttgtacttatttttgtttttattgttgcaaaaaaatgttaatgggctgttgaaatgacctccatttacttaaggtaatccaataaggtcttttttaaatatacaaattttactcaagtttaaattgtataaaactgcttagaaacctgaaattttatagtgtgtaatatcttatgtgtatatagcatcctgagctgtgtgatacagtagatttcttcttagcagaaacatgcgaggtagatttaataaacaacaaaaatcagcttatgtttctacttattgaatctgctttactttttagcaattttcttccttgtgaacatgaaccatataaagtgtctgtgacttaatgatttcatgtaagtctgtcgcatacatccttcttttgtagcttacaccatgtggatgctctgtctgtagacactgcttgataaaaggagaataaacctcttacattttaacccttga

SEQ ID NO: 290704 - DNA, 2617 bp, Homo sapiens
agagcgatgtagactaaaaaagttcataaatataatgaataaaaacgcaaaatttaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaaaaaccctacgatacaattattgaatgaagcgttttacaatacattgcacttaatccattgtttaaatttacaacttaactttccaagtttatatcctagtcaaacaaaatttacttggttggtccaaataaaataaattgtttttgactaagtgactaagacatacacaattaattatattggttaattagaaatactcagcacaatatttaatgagaaatcacatcagtcacaagaatcaaatatgtaaattatgctttaaacaataaagtaggatttaaatcatttaaaaaactaaactgcagggaatttcagatgacataaagcattatttcattttgagggtagtttattttttttctctgtccttttggtatgattaaacaagaaataaaaggtgttgtggaaacttaaaattcttaattcaaaatattcggtcctgtccactgtttataatattttgtgccttgaagggaatgtcacaggaggaaaaggaagactaaagcctgcatactaaatgctctcataactataaatctcttgttgttaaaaaacatctcttgcaccaaatcctgtcttcagtcttttgtttaaccctcaatgaactaccaattgaaggcataagttggtcttaggttgtatacaggtgtcaaactccacttgacatttactgtataatctgcagcatgctatagaaagtggggaggaagggaggaaaaataattacagtcaaaatatttgcaatctatctactcattttgctttcaatcactagagtgcattatgtttttaatgcaagtttgtctgggatgtcaactgcctacagatgtttattactagcagaatagattatttattaatagattgtttcttttcatatagtccaatgtttcatcatcaggaactttcggttttaaaaaagaaacattacttttgtctgctaaagtaaaccatatatagggaaattaacacctaggaaaagaaaactggcaagagaattgatgaggtattagtggcttagaagaattagtaatataagttgggaataaaggggtagcccgacagtggtaagtaaaaatgtagtactccattgtttttgctatttaaatataatgtatcaaaaacctttattctaaaatttccacaaatgattccttttatccatcttcttgtaatcctaaaagcatcttctcactatgtgctgtagtttgaaacctaacgaatcctcctacttgagacactgtagaaaagtaaaaattgttgcttctgttttgttttaagaggaaatgagaaggccagcagaagtagattaaaactagagagctggtttattaaaataagcagataattatccaggcttaaagtaatagcttacatgttttgaaaatccttgtacttatttttgtttttattgttgcaaaaaaatgttaatgggctgttgaaatgacctccatttacttaaggtaatccaataaggtcttttttaaatatacaaattttactcaagtttaaattgtataaaactgcttagaaacctgaaattttatagtgtgtaatatcttatgtgtatatagcatcctgagctgtgtgatacagtagatttcttcttagcagaaacatgcgaggtagatttaataaacaacaaaaatcagcttatgtttctacttattgaatctgctttactttttagcaattttcttccttgtgaacatgaaccatataaagtgtctgtgacttaatgatttcatgtaagtctgtcgcatacatccttcttttgtagcttacaccatgtggatgctctgtctgtagacactgcttgataaaaggagaataaacctcttacattttaacccttga

SEQ ID NO: 290705 - DNA, 3803 bp, Homo sapiens
agtcccaattagatgcgacggcttcagcctggtcaaggtgaaggaaagttgcttccgcgcctaggaagtgggtttgcctgataagagaaggaggaggggactcggctgggaagagctcccctcccctccgcggaagaccactgggtcccctctttccccaacctcctccctctcttctactccacccctccgttttcccactccccactgactcggatgcctggatgttctgccaccgggcagtggtccagcgtgcagccgggagggggcaggggcagggggcactgtgacaggaagctgcgcgcacaagttggccatttcgagggcaaaataagttctcccttggatttggaaaggacaaagccagtaagctacctcttttgtgtcggatgaggaggaccaaccatgagccagagcccgggtgcaggctcaccgccgccgctgccaccgcggtcagctccagttcctgccaggagttgtcggtgcgaggaattttgtgacaggctctgttagtctgttcctcccttatttgaaggacaggccaaagatccagtttggaaatgagagaggactagcatgacacattggctccaccattgatatctcccagaggtacagaaacaggattcatgaagatgttgacaagactgcaagttcttaccttagctttgttttcaaagggatttttactctctttaggggaccataactttctaaggagagagattaaaatagaaggtgaccttgttttagggggcctgtttcctattaacgaaaaaggcactggaactgaagaatgtgggcgaatcaatgaagaccgagggattcaacgcctggaagccatgttgtttgctattgatgaaatcaacaaagatgattacttgctaccaggagtgaagttgggtgttcacattttggatacatgttcaagggatacctatgcattggagcaatcactggagtttgtcagggcatctttgacaaaagtggatgaagctgagtatatgtgtcctgatggatcctatgccattcaagaaaacatcccacttctcattgcaggggtcattggtggctcttatagcagtgtttccatacaggtggcaaacctgctgcggctcttccagatccctcagatcagctacgcatccaccagcgccaaactcagtgataagtcgcgctatgattactttgccaggaccgtgccccccgacttctaccaggccaaagccatggctgagatcttgcgcttcttcaactggacctacgtgtccacagtagcctccgagggtgattacggggagacagggatcgaggccttcgagcaggaagcccgcctgcgcaacatctgcatcgctacggcggagaaggtgggccgctccaacatccgcaagtcctacgacagcgtgatccgagaactgttgcagaagcccaacgcgcgcgtcgtggtcctcttcatgcgcagcgacgactcgcgggagctcattgcagccgccagccgcgccaatgcctccttcacctgggtggccagcgacggctggggcgcgcaggagagcatcatcaagggcagcgagcatgtggcctacggcgccatcaccctggagctggcctcccagcctgtccgccagttcgaccgctacttccagagcctcaacccctacaacaaccaccgcaacccctggttccgggacttctgggagcaaaagtttcagtgcagcctccagaacaaacgcaaccacaggcgcgtctgcgacaagcacctggccatcgacagcagcaactacgagcaagagtccaagatcatgtttgtggtgaacgcggtgtatgccatggcccacgctttgcacaaaatgcagcgcaccctctgtcccaacactaccaagctttgtgatgctatgaagatcctggatgggaagaagttgtacaaggattacttgctgaaaatcaacttcacggctccattcaacccaaataaagatgcagatagcatagtcaagtttgacacttttggagatggaatggggcgatacaacgtgttcaatttccaaaatgtaggtggaaagtattcctacttgaaagttggtcactgggcagaaaccttatcgctagatgtcaactctatccactggtcccggaactcagtccccacttcccagtgcagcgacccctgtgcccccaatgaaatgaagaatatgcaaccaggggatgtctgctgctggatttgcatcccctgtgaaccctacgaatacctggctgatgagtttacctgtatggattgtgggtctggacagtggcccactgcagacctaactggatgctatgaccttcctgaggactacatcaggtgggaagacgcctgggccattggcccagtcaccattgcctgtctgggttttatgtgtacatgcatggttgtaactgtttttatcaagcacaacaacacacccttggtcaaagcatcgggccgagaactctgctacatcttattgtttggggttggcctgtcatactgcatgacattcttcttcattgccaagccatcaccagtcatctgtgcattgcgccgactcgggctggggagttccttcgctatctgttactcagccctgctgaccaagacaaactgcattgcccgcatcttcgatggggtcaagaatggcgctcagaggccaaaattcatcagccccagttctcaggttttcatctgcctgggtctgatcctggtgcaaattgtgatggtgtctgtgtggctcatcctggaggccccaggcaccaggaggtatacccttgcagagaagcgggaaacagtcatcctaaaatgcaatgtcaaagattccagcatgttgatctctcttacctacgatgtgatcctggtgatcttatgcactgtgtacgccttcaaaacgcggaagtgcccagaaaatttcaacgaagctaagttcataggttttaccatgtacaccacgtgcatcatctggttggccttcctccctatattttatgtgacatcaagtgactacagagtgcagacgacaaccatgtgcatctctgtcagcctgagtggctttgtggtcttgggctgtttgtttgcacccaaggttcacatcatcctgtttcaaccccagaagaatgttgtcacacacagactgcacctcaacaggttcagtgtcagtggaactgggaccacatactctcagtcctctgcaagcacgtatgtgccaacggtgtgcaatgggcgggaagtcctcgactccaccacctcatctctgtgattgtgaattgcagttcagttcttgtgtttttagactgttagacaaaagtgctcacgtgcagctccagaatatggaaacagagcaaaagaacaaccctagtacctttttttagaaacagtacgataaattatttttgaggactgtatatagtgatgtgctagaactttctaggctgagtctagtgcccctattattaacaattcccccagaacatggaaataaccattgtttacagagctgagcattggtgacagggtctgacatggtcagtctactaaaaaacaaaaaaaaaaaacaaaaaaaaaaaaacaaaagaaaaaaataaaaatacggtggcaatattatgtaaccttttttcctatgaagttttttgtaggtccttgttgtaactaatttaggatgagtttctatgttgtatattaaagttacattatgtgtaacagattgattttctcagcacaaaataaaaagcatctgtattaatgtaaagatactgagaataaaaccttcaaggttttccagcatggtggataa

SEQ ID NO: 290706 - DNA, 1129 bp, Homo sapiens
ttccgcttcggggaaggggcggagcctgagggacccggcggctggtgagcgcccgctggaggctggagcttccgggccctggaaaggggtccccgcgcgccccgggtcggaggcagacccctgggtttgggggacatgggcatttggggcgcctgaacccaagacctctggatgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggccctgtgccctggtggcagcccccagcaccaggacctcgctgggcagctggtggtacatgaactcttttccagtgtccttcaggagatctgtgatgaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290707 - DNA, 851 bp, Homo sapiens
attcggcaccaggggagggacccggcggctgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggtgcagcctgacttctgagcaggtgaggaagcactacctgagtgggggacccgaggcccacgagtctacaggaatcttctttgtggagacacagagaggctccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagc

SEQ ID NO: 290708 - DNA, 1158 bp, Homo sapiens
ttccgcttcggggaaggggcggagcctgagggacccggcggctggtgagcgcccgctggaggctggagcttccgggccctggaaaggggtccccgcgcgccccgggtcggaggcagacccctgggtttgggggacatgggcatttggggcgcctgaacccaagacctctggatgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggccctgtgccctggtggcagcccccagcaccaggacctcgctgggcagctggtggtacatgaactcttttccagtgtccttcaggagatctgtgatgaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttggaaagacacgtcggcatctgctatttctgt

SEQ ID NO: 290709 - DNA, 1080 bp, Homo sapiens
  misc_feature (26)..(27): n is a, c, g, or t
ctgctggtacggccccgcggattttnnggatggaaaggggtccccgcgcgccccgggtcggaggcagacccctgggtttgggggacatgggcatttggggcgcctgaacccaagacctctggatgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggccctgtgccctggtggcagcccccagcaccaggacctcgctgggcagctggtggtacatgaactcttttccagtgtccttcaggagatctgtgatgaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290710 - DNA, 986 bp, Homo sapiens
attcggcaccaggggagggacccggcggctgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggccctgtgccctggtggcagcccccagcaccaggacctcgctgggcagctggtggtacatgaactcttttccagtgtccttcaggagatctgtgatgaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290711 - DNA, 974 bp, Homo sapiens
acgtatctgctcctggggcaggcccccgccagggcactgcagcagcaaggtcacctcaggatccatggtctgaacggggcagctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggccctgtgccctggtggcagcccccagcaccaggacctcgctgggcagctggtggtacatgaactcttttccagtgtccttcaggagatctgtgatgaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290712 - DNA, 1081 bp, Homo sapiens
gtggtaccggccgagtcttaggatcggcggctgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcagctggacctctggttgtctgtcagggaaaggacaccagactcaggatcactaactctcttacactgtgccacatcagaccctcaaggccagcaggccctgtgccctggtggcagcccccagcaccaggacctcgctgggcagctggtggtacatgaactcttttccagtgtccttcaggagatctgtgatgaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290713 - DNA, 1237 bp, Homo sapiens
ttccgcttcggggaaggggcggagcctgagggacccggcggctggtgagcgcccgctggaggctggagcttccgggccctggaaaggggtccccgcgcgccccgggtcggaggcagacccctgggtttgggggacatgggcatttggggcgcctgaacccaagacctctggatggtagggatgcccgggcgtcctggataccctgcgggactcggggctcctgcggggaagatggcacgttttactgcccaaggagtggtcaggggggtggagaagcgctgcggataccctcaggaggtctgcgacagagggggctagctgcgcagcccaggagtggtagtggcccccctggatgacaggcctggccgtatcctcccccagagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290714 - DNA, 1098 bp, Homo sapiens
ttccgcttcggggaaggggcggagcctgagggacccggcggctggtgagcgcccgctggaggctggagcttccgggccctggaaaggggtccccgcgcgccccgggtcggaggcagacccctgggtttgggggacatgggcatttggggcgcctgaacccaagacctctggatggtagggatgcccgggcgtcctggataccctgcgggactcggggctcctgcggggaagatggcacgttttactgcccaaggagtggtcaggggggtggagaagcgctgcggataccctcaggaggtctgcgacagagggggctagctgcgcagcccaggagtggtagtggcccccctggatgacaggcctggccgtatcctcccccagagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctgggctggtggacgtacctggtgggcaccctgagcctcaggccctgtgccctggtggcagcccccagcaccaggacctcgctgggcagctggtggtacatgaactcttttccagtgtccttcaggagatctgtgatgaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290715 - DNA, 1047 bp, Homo sapiens
ttccgcttcggggaaggggcggagcctgagggacccggcggctggtgagcgcccgctggaggctggagcttccgggccctggaaaggggtccccgcgcgccccgggtcggaggcagacccctgggtttgggggacatgggcatttggggcgcctgaacccaagacctctggatggtagggatgcccgggcgtcctggataccctgcgggactcggggctcctgcggggaagatggcacgttttactgcccaaggagtggtcaggggggtggagaagcgctgcggataccctcaggaggtctgcgacagagggggctagctgcgcagcccaggagtggtagtggcccccctggatgacaggcctggccgtatcctcccccagagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacaggtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290716 - DNA, 925 bp, Homo sapiens
ttccgcttcggggaaggggcggagcctgagggacccggcggctggtgagcgcccgctggaggctggagcttccgggccctggaaaggggtccccgcgcgccccgggtcggaggcagacccctgggtttgggggacatgggcatttggggcgcctgaacccaagacctctggatggtagggatgcccgggcgtcctggataccctgcgggactcggggctcctgcggggaagatggcacgttttactgcccaaggagtggtcaggggggtggagaagcgctgcggataccctcaggaggtctgcgacagagggggctagctgcgcagcccaggagtggtagtggcccccctggatgacaggcctggccgtatcctcccccagagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290717 - DNA, 644 bp, Homo sapiens
tgcccatcatctgacattctgtaatgctgggtccttgatctacaagctataaaatgctgtacacaggtaacaggcggtttttcattgagacgggcagggatgtgggcagtggcattgataggtgggacctccccccaccccaccctccaccgcagtgaacctgccgctgctcaccctgagccagcccctgctgttgggcatcgcccgaaatgagaccagtgctggccgagccagtgccgagttctatgtccagtgagtaggctcgggtacatgatcctgggtcttgggaaggtgggtggtgaggagtgggctgaggcagctgtggctccacaggtaccccgcaggggctggtcacccactaagccacccttgtgttcttgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290718 - DNA, 336 bp, Homo sapiens
tatgtccagtgagtaggctcgggtacatgatcctgggtcttgggaaggtgggtggtgaggagtgggctgaggcagctgtggctccacaggtaccccgcaggggctggtcacccactaagccacccttgtgttcttgtccagtgcagcctgacttctgagcaggtgaggaagcactacctgagtgggggacccgaggcccacgagtctacaggaatcttctttgtggagacacaggtgcagagtgacaaaccatcttgcttggaggccagggctggggcctgcagaggcctggcaatgcatatcttgtaggggaggtgttggctgggtcacaattcc

SEQ ID NO: 290719 - DNA, 512 bp, Homo sapiens
tgcccatcatctgacattctgtaatgctgggtccttgatctacaagctataaaatgctgtacacaggtaacaggcggtttttcattgagacgggcagggatgtgggcagtggcattgataggtgggacctccccccaccccaccctccaccgcagtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290720 - DNA, 445 bp, Homo sapiens
tttcctggcccgctcggcaggccccaactggccccccccactgcctcgtgcgcacgaggcagtgatggggggtggagaagcgctgcggataccctcaggaggtctgcgacagagggggctagctgcgcagcccaggagtggtagtggcccccctggatgacaggcctggccgtatcctcccccagagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccacattgattctgtataggtataggcactgttgaatctggaccga

SEQ ID NO: 290721 - DNA, 1336 bp, Homo sapiens
ttccgcttcggggaaggggcggagcctgagggacccggcggctggtgagcgcccgctggaggctggagcttccgggccctggaaaggggtccccgcgcgccccgggtcggaggcagacccctgggtttgggggacatgggcatttggggcgcctgaacccaagacctctggatggtagggatgcccgggcgtcctggataccctgcgggactcggggctcctgcggggaagatggcacgttttactgcccaaggagtggtcaggggggtggagaagcgctgcggataccctcaggaggtctgcgacagagggggctagctgcgcagcccaggagtggtagtggcccccctggatgacaggcctggccgtatcctcccccagagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggccctgtgccctggtggcagcccccagcaccaggacctcgctgggcagctggtggtacatgaactcttttccagtgtccttcaggagatctgtgatgaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290722 - DNA, 999 bp, Homo sapiens
ttccgcttcggggaaggggcggagcctgagggacccggcggctgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggccctgtgccctggtggcagcccccagcaccaggacctcgctgggcagctggtggtacatgaactcttttccagtgtccttcaggagatctgtgatgaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290723 - DNA, 1429 bp, Homo sapiens
ttccgcttcggggaaggggcggagcctgagggacccggcggctggtgagcgcccgctggaggctggagcttccgggccctggaaaggggtccccgcgcgccccgggtcggaggcagacccctgggtttgggggacatgggcatttggggcgcctgaacccaagacctctggatggtagggatgcccgggcgtcctggataccctgcgggactcggggctcctgcggggaagatggcacgttttactgcccaaggagtggtcaggggggtggagaagcgctgcggataccctcaggaggtctgcgacagagggggctagctgcgcagcccaggagtggtagtggcccccctggatgacaggcctggccgtatcctcccccagagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcagctggacctctggttgtctgtcagggaaaggacaccagactcaggatcactaactctcttacactgtgccacatcagaccctcaaggccagcaggccctgtgccctggtggcagcccccagcaccaggacctcgctgggcagctggtggtacatgaactcttttccagtgtccttcaggagatctgtgatgaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290724 - DNA, 1261 bp, Homo sapiens
ttccgcttcggggaaggggcggagcctgagggacccggcggctggtgagcgcccgctggaggctggagcttccgggccctggaaaggggtccccgcgcgccccgggtcggaggcagacccctgggtttgggggacatgggcatttggggcgcctgaacccaagacctctggatgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggccctgtgccctggtggcagcccccagcaccaggacctcgctgggcagctggtggtacatgaactcttttccagtgtccttcaggagatctgtgatgaggtgaacctgccgctgctcaccctgagccagcccctgctgttgggcatcgcccgaaatgagaccagtgctggccgagccagtgccgagttctatgtccagtgagtaggctcgggtacatgatcctgggtcttgggaaggtgggtggtgaggagtgggctgaggcagctgtggctccacaggtaccccgcaggggctggtcacccactaagccacccttgtgttcttgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290725 - DNA, 981 bp, Homo sapiens
  misc_feature (26)..(27): n is a, c, g, or t
ctgctggtacggccccgcggattttnnggatggaaaggggtccccgcgcgccccgggtcggaggcagacccctgggtttgggggacatgggcatttggggcgcctgaacccaagacctctggatgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290726 - DNA, 532 bp, Homo sapiens
ttccgcttcggggaaggggcggagcctgagggacccggcggctggtgagcgcccgctggaggctggagcttccgggccctggaaaggggtccccgcgcgccccgggtcggaggcagacccctgggtttgggggacatgggcatttggggcgcctgaacccaagacctctggatggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttgg

SEQ ID NO: 290727 - DNA, 935 bp, Homo sapiens
agagcggcaggtagaaggcgcctacggtggagaacacggcgtaggaaggctcgcggcttacctggcactcctcgctgccctcagagtacgtctctccccagccaaaaagcagcggggccagagagatgacagcggagagtgcccaggtgagcgcgatcatgacgttggagacgcacttgcgggtgcggagcgtgtattccatgtggcgcgtgatggaccagtagcggtccagggctatggccgtcacgttccagatgctggccgtgcagcaaagcacgtcgcacgcgatccaaagctggcacagcctccgacctagctgccagcggcgcccggacagctcgtgcaccaggctcagcggcatgaccagcgcggccaccaggacatccgagacggccatggatgccaccaggttgtggggcacgcggtggaaggtgcgtacacggaggatggtcgccagcaccagcaggttccaggcgaacgtcgccgccaccagaaagcccagcaagagtaaaacaagtatcaggagaatgcactgagaaaagagaaagtcctccactggaacctagaggacgggacaacatcattaaataccggattattcacagggctgtttcaaacaccacttaaaaacagctgatggtgactgcctgcatgcagagcaactgtgcatggccccaatctggaagcaagcttgtgcttctttaaggcaaatcaccttcttgaggtcatggaactaatgggaatgagatgtaaactatgaatcctcttctttggaacaagttctgcatctagtctcagggcctgttatctggaggaatggatgaactgtgttgcccacaggcgggcctcaatggatctctatgaatcttgaaaggcattatgggcttgtgattatattccctactgattccccaggccacagctgtctgtattga

SEQ ID NO: 290728 - DNA, 455 bp, Homo sapiens
gtcagaccctgtctcatggaaaaaaaaagacgtttgcatgaatattttaaattcctttttttccccttaatcacacagcattggcatcaacaaaagtcagaattcccgggaacttgaacagaggctgctaaattcccagtaattgctcctttggccttctagggactgacttcaaagaaggaaggaaagaatcaggcaggtaaagctttccgtgtcttgttcttactgccaggccatctatctcggtccccacgggcagcaccagggagtgaggctggcaacagagcaggggaagggccctgtctggacctgaagccatgggggcacaatggagagttttctttctgtgagaaacgctgtttactgatctggacactgggtgcttgttctcaacaatatgcctttgagttccagcttcacttaacccagcttacctcacccgtggtaccgactgt

SEQ ID NO: 290729 - DNA, 2630 bp, Homo sapiens
  misc_feature (2308)..(2308): n is a, c, g, or t
  misc_feature (2323)..(2323): n is a, c, g, or t
tgcatcatcgccgctgactgcatcaacgccgcgctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactggagaaaaaccctatgaatgtaatgaatgtgggaaagccttcagccagagctcacacctctatcagcaccagagaatccacactggagagaagccctacgaatgtatggaatgtggaggaaagtttacctacagttcaggccttattcagcatcaaagaatccacaccggggagaacccctatgaatgtagtgagtgtgggaaagccttcaggtacagctcggctcttgttcgccatcagagaattcacactggagagaagcctttgaatgggatcggcatgagcaaaagctccctcagagttacgaccgagttaaatatcagagagtccacgtgaaagagccacacacccattttcctcactttccctgagtctcaagagctcttgccttaccctataaatctcaacagcttaggatgtgtccctttcaactcagacttttcattttagagaatggggcagatggggcaaatcgttgaattttcccagaaatcacaccagccttagaaagcgtcaaggcaagtggatggcgtgctgggaatagaaagcagctctgggaccagttaccccatttaggaaaggagtttgcactaaactgtttttctcacagcagaggaacctttccaaggtggggatggaagcacagtcgggacagaattcgatggattcctttagttggagtccgcgtagtcagcacagacagcagtggaaaggacgctctgggtcctgttatttgctagggagggtaaagggagactatttcaaagctactgttcctagtccagctttaagtttcggtaagaaacatgctgttttgtttcatgatttcgttaattatggaaatttggcattgagggattattttattgagggtagaagagattccagaatcatcatctgtgatgatggtgtcctttagggctcttggagcagccagaccatgtttccaagagaaacctggtgatattgccagcagaccncctgccatccccccnagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgccctgccctctcacctctgacacccagccccaggagccagaccactcctgcctccacctctgactcttcagcagctgaagattaatgcagagaaagagcaaagcccaaaagggag

SEQ ID NO: 290730 - DNA, 2539 bp, Homo sapiens
  misc_feature (2161)..(2161): n is a, c, g, or t
  misc_feature (2170)..(2170): n is a, c, g, or t
  misc_feature (2173)..(2174): n is a, c, g, or t
  misc_feature (2189)..(2189): n is a, c, g, or t
  misc_feature (2191)..(2191): n is a, c, g, or t
tgcatcatcgccgctgactgcatcaacgccgcgctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactgaagctcttcccacattcgttacactgataaggcttctccccagtgtggatccgatagtgacgaatgaggctgcctttcccgctgaaagccttgccacaatctttgcactgatatggcgcctcttctgtgtgcattctctgatgtttaagaaggtctgagctctgcccaaaagcttttccacacttacagtcatagggccggtccaccaagtgtgttctgtagtggagggtgaggtttgagctgtggctgaaagctttcccacacttggtgcacacgtaaggtttctccccagtgtgtgttctcctgtgtttggtgagatttgagctattactaaaggctttgccacattcagcacatatataacgtctctctcctggggtaggtttagtaggaactgattctctacctttcttggagcctgcctcttgaagagggggttttgttcctttttcattttcaaggtttacgcactgcctctctaagctggcctcaggtttattggcgataatcacagaaattatatcccctttgagcccctctgcttcagaacctttctgctcatctgctgattcctcgtgctgggtactcaatctgcaatctgaaacaataagcagattaaggatacttcagttgtttcttgttctgaggaagaaactgttaccagagagatagaaccatcaggtgagactgatggtttctgaagggtgactaaacagagctcatgatagcgcatagatacaagtaaatcagcatccaatctagtttacaatactgcacttctttttttttttgagatggagtctcgctgtcagcaggctggaatgcagtgagntgagatgcnccnntgcactccagcctgngngacagagtgaaattccgtcttaagaaaaataaagaaaatttaaaaataccgggcgcggtggctcacgcctgtaatcccagctctcagggaggcaacaggtgggaggatagcttgagcccaggagttccagacctgcctgggcaatatagcgagaccctgttctccacaaaaaggaaaaaaaaaaaattaaaaaataaaagacaataaaagactagtcccagttgccacatttcttctcactgtacctgggtactcactgaaatactagctcccatctttctgtctacaggaggttttttcgaattatctttgaaccttgaacttttgcttctgcagtgcttccggtcg

SEQ ID NO: 290731 - DNA, 2434 bp, Homo sapiens
tgcatcatcgccgctgactgcatcaacgccgcgctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactgaagctcttcccacattcgttacactgataaggcttctccccagtgtggatccgatagtgacgaatgaggctgcctttcccgctgaaagccttgccacaatctttgcactgatatggcgcctcttctgtgtgcattctctgatgtttaagaaggtctgagctctgcccaaaagcttttccacacttacagtcatagggccggtccaccaagtgtgttctgtagtggagggtgaggtttgagctgtggctgaaagctttcccacacttggtgcacacgtaaggtttctccccagtgtgtgttctcctgtgtttggtgagatttgagctattactaaaggctttgccacattcagcacatatataacgtctctctcctggggtaggtttagtaggaactgattctctacctttcttggagcctgcctcttgaagagggggttttgttcctttttcattttcaaggtttacgcactgcctctctaagctggcctcaggtttattggcgataatcacagaaattatatcccctttgagcccctctgcttcagaacctttctgctcatctgctgattcctcgtgctgggtactcaatctgcaatctgaaacaataagcagattaaggatacttcagttgtttcttgttctgaggaagaaactgttaccagagagatagaaccatcaggtgagactgatggtttctgaagggtgactaaacagagctcatgatagcgcatagatacaagtaaatcagcatccaatctagtttacaatactgcacttctttttttttttgagatggagtctcgctgtcagcaggctggaatgcaggtgacctcagctcactgcaacctccaactccctgattcaagcgattctcctgcctcagcctccagagtagctggaattacaggcacgtgccaccacacccagctattttttgtatttttttttagtagagatggggtttcaacatgctggccaggatggtcttgatctcctgacctcaggtgatccgcctgcctcagcctcccagagtgctgggattataggcatgagccaccaggcctggcctccataccacactttcacacaattccccacccgaa

SEQ ID NO: 290732 - DNA, 2502 bp, Homo sapiens
  misc_feature (2124)..(2124): n is a, c, g, or t
  misc_feature (2133)..(2133): n is a, c, g, or t
  misc_feature (2136)..(2137): n is a, c, g, or t
  misc_feature (2152)..(2152): n is a, c, g, or t
  misc_feature (2154)..(2154): n is a, c, g, or t
cggtatgatattcaccaccgcgtcgggtctggagcctcagaatgctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactgaagctcttcccacattcgttacactgataaggcttctccccagtgtggatccgatagtgacgaatgaggctgcctttcccgctgaaagccttgccacaatctttgcactgatatggcgcctcttctgtgtgcattctctgatgtttaagaaggtctgagctctgcccaaaagcttttccacacttacagtcatagggccggtccaccaagtgtgttctgtagtggagggtgaggtttgagctgtggctgaaagctttcccacacttggtgcacacgtaaggtttctccccagtgtgtgttctcctgtgtttggtgagatttgagctattactaaaggctttgccacattcagcacatatataacgtctctctcctggggtaggtttagtaggaactgattctctacctttcttggagcctgcctcttgaagagggggttttgttcctttttcattttcaaggtttacgcactgcctctctaagctggcctcaggtttattggcgataatcacagaaattatatcccctttgagcccctctgcttcagaacctttctgctcatctgctgattcctcgtgctgggtactcaatctgcaatctgaaacaataagcagattaaggatacttcagttgtttcttgttctgaggaagaaactgttaccagagagatagaaccatcaggtgagactgatggtttctgaagggtgactaaacagagctcatgatagcgcatagatacaagtaaatcagcatccaatctagtttacaatactgcacttctttttttttttgagatggagtctcgctgtcagcaggctggaatgcagtgagntgagatgcnccnntgcactccagcctgngngacagagtgaaattccgtcttaagaaaaataaagaaaatttaaaaataccgggcgcggtggctcacgcctgtaatcccagctctcagggaggcaacaggtgggaggatagcttgagcccaggagttccagacctgcctgggcaatatagcgagaccctgttctccacaaaaaggaaaaaaaaaaaattaaaaaataaaagacaataaaagactagtcccagttgccacatttcttctcactgtacctgggtactcactgaaatactagctcccatctttctgtctacaggaggttttttcgaattatctttgaaccttgaacttttgcttctgcagtgcttccggtcg

SEQ ID NO: 290733 - DNA, 2421 bp, Homo sapiens
  misc_feature (2043)..(2043): n is a, c, g, or t
  misc_feature (2052)..(2052): n is a, c, g, or t
  misc_feature (2055)..(2056): n is a, c, g, or t
  misc_feature (2071)..(2071): n is a, c, g, or t
  misc_feature (2073)..(2073): n is a, c, g, or t
tgcatcatcgccgctgactgcatcaacgccgcgctttgttctgtccccggtgtgtgggtctgtgacagggtccaacagggcctggtccgtgtccggtcccccaaatctgtcgtccctgcccccaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactgaagctcttcccacattcgttacactgataaggcttctccccagtgtggatccgatagtgacgaatgaggctgcctttcccgctgaaagccttgccacaatctttgcactgatatggcgcctcttctgtgtgcattctctgatgtttaagaaggtctgagctctgcccaaaagcttttccacacttacagtcatagggccggtccaccaagtgtgttctgtagtggagggtgaggtttgagctgtggctgaaagctttcccacacttggtgcacacgtaaggtttctccccagtgtgtgttctcctgtgtttggtgagatttgagctattactaaaggctttgccacattcagcacatatataacgtctctctcctggggtaggtttagtaggaactgattctctacctttcttggagcctgcctcttgaagagggggttttgttcctttttcattttcaaggtttacgcactgcctctctaagctggcctcaggtttattggcgataatcacagaaattatatcccctttgagcccctctgcttcagaacctttctgctcatctgctgattcctcgtgctgggtactcaatctgcaatctgaaacaataagcagattaaggatacttcagttgtttcttgttctgaggaagaaactgttaccagagagatagaaccatcaggtgagactgatggtttctgaagggtgactaaacagagctcatgatagcgcatagatacaagtaaatcagcatccaatctagtttacaatactgcacttctttttttttttgagatggagtctcgctgtcagcaggctggaatgcagtgagntgagatgcnccnntgcactccagcctgngngacagagtgaaattccgtcttaagaaaaataaagaaaatttaaaaataccgggcgcggtggctcacgcctgtaatcccagctctcagggaggcaacaggtgggaggatagcttgagcccaggagttccagacctgcctgggcaatatagcgagaccctgttctccacaaaaaggaaaaaaaaaaaattaaaaaataaaagacaataaaagactagtcccagttgccacatttcttctcactgtacctgggtactcactgaaatactagctcccatctttctgtctacaggaggttttttcgaattatctttgaaccttgaacttttgcttctgcagtgcttccggtcg

SEQ ID NO: 290734 - DNA, 1471 bp, Homo sapiens
tgcatcatcgccgctgactgcatcaacgccgcgctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggactggatacacgtctgtttaactacgcaaaaggtaatgctggcatggcttactgggaccctaagtgtggcgaagggactctgctccagtgaactggcgagtgtggaacctcctgacaccttctgaggacctcctgcctgccatgttgctgtggagctcgcactcctcaggcatcccctgatgttgagtgatacaaactctatcaccggaatcgatgctgctgcaatgacaagacttctttctggttttcagattctaaagtttaaaacaacgacaacaacaggagcgcttgaaagttacggtgcttctccctctccagtgtggactcgctgatgtttggaaagattggacttgctacagaaggtctttccacagtgatgacaccagtagggcttttccccggtgtggattctgtggtgtttattgaagttggagctgtggttgaaggctttcccacactccttacacttatatggcttctctccggtgtggagtctctggtgggagctgaggcccgcatgctgactgaagctcttcccacattcgttacactgataaggcttctccccagtgtggatccgatagtgacgaatgaggctgcctttcccgctgaaagccttgccacaatctttgcactgatatggcgcctcttctgtgtgcattctctgatgtttaagaaggtctgagctctgcccaaaagcttttccacacttacagtcatagggccggtccaccaagtgtgttctgtagtggagggtgaggtttgagctgtggctgaaagctttcccacacttggtgcacacgtaaggtttctccccagtgtgtgttctcctgtgtttggtgagatttgagctattactaaaggctttgccacattc

SEQ ID NO: 290735 - DNA, 2611 bp, Homo sapiens
  misc_feature (2233)..(2233): n is a, c, g, or t
  misc_feature (2242)..(2242): n is a, c, g, or t
  misc_feature (2245)..(2246): n is a, c, g, or t
  misc_feature (2261)..(2261): n is a, c, g, or t
  misc_feature (2263)..(2263): n is a, c, g, or t
tgcatcatcgccgctgactgcatcaacgccgcgctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggtgagctgtggttccgtttatccttttcctttccattttctgtgcaatgacatcccattcagagctttaaaccctgatctcctccatcaggcccatggttctgtcctgctgaatcatggaccctcaccttctatcttggactcctgtctctcttcctccaccctgtcctcccttcctcccttcccaaatgtgcatttttcaccccatcctcagtgatttttttggtgccgccattcacattcctcaccctgaaattgcatgccagcacgtgttgtttcaggagctggtaacctttgaggatgtagctgtgtacttcatccggaaggagtggaagcgtttggaacctgctcagagggacctctatagagatgtgatgctggagaattacgggaatgtgttctcactggactggatacacgtctgtttaactacgcaaaaggtaatgctggcatggcttactgggaccctaagtgtggcgaagggactctgctccagtgaactggcgagtgtggaacctcctgacaccttctgaggacctcctgcctgccatgttgctgtggagctcgcactcctcaggcatcccctgatgttgagtgatacaaactctatcaccggaatcgatgctgctgcaatgacaagacttctttctggttttcagattctaaagtttaaaacaacgacaacaacaggagcgcttgaaagttacggtgcttctccctctccagtgtggactcgctgatgtttggaaagattggacttgctacagaaggtctttccacagtgatgacaccagtagggcttttccccggtgtggattctgtggtgtttattgaagttggagctgtggttgaaggctttcccacactccttacacttatatggcttctctccggtgtggagtctctggtgggagctgaggcccgcatgctgactgaagctcttcccacattcgttacactgataaggcttctccccagtgtggatccgatagtgacgaatgaggctgcctttcccgctgaaagccttgccacaatctttgcactgatatggcgcctcttctgtgtgcattctctgatgtttaagaaggtctgagctctgcccaaaagcttttccacacttacagtcatagggccggtccaccaagtgtgttctgtagtggagggtgaggtttgagctgtggctgaaagctttcccacacttggtgcacacgtaaggtttctccccagtgtgtgttctcctgtgtttggtgagatttgagctattactaaaggctttgccacattcagcacatatataacgtctctctcctggggtaggtttagtaggaactgattctctacctttcttggagcctgcctcttgaagagggggttttgttcctttttcattttcaaggtttacgcactgcctctctaagctggcctcaggtttattggcgataatcacagaaattatatcccctttgagcccctctgcttcagaacctttctgctcatctgctgattcctcgtgctgggtactcaatctgcaatctgaaacaataagcagattaaggatacttcagttgtttcttgttctgaggaagaaactgttaccagagagatagaaccatcaggtgagactgatggtttctgaagggtgactaaacagagctcatgatagcgcatagatacaagtaaatcagcatccaatctagtttacaatactgcacttctttttttttttgagatggagtctcgctgtcagcaggctggaatgcagtgagntgagatgcnccnntgcactccagcctgngngacagagtgaaattccgtcttaagaaaaataaagaaaatttaaaaataccgggcgcggtggctcacgcctgtaatcccagctctcagggaggcaacaggtgggaggatagcttgagcccaggagttccagacctgcctgggcaatatagcgagaccctgttctccacaaaaaggaaaaaaaaaaaattaaaaaataaaagacaataaaagactagtcccagttgccacatttcttctcactgtacctgggtactcactgaaatactagctcccatctttctgtctacaggaggttttttcgaattatctttgaaccttgaacttttgcttctgcagtgcttccggtcg

SEQ ID NO: 290736 - DNA, 2403 bp, Homo sapiens
  misc_feature (2025)..(2025): n is a, c, g, or t
  misc_feature (2034)..(2034): n is a, c, g, or t
  misc_feature (2037)..(2038): n is a, c, g, or t
  misc_feature (2053)..(2053): n is a, c, g, or t
  misc_feature (2055)..(2055): n is a, c, g, or t
tgcatcatcgccgctgactgcatcaacgccgcgctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtggtgaggaataaggactcattcattcttttactcagtcattctgcaatcatccattgaaatcgctcacttacgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggactggatacacgtctgtttaactacgcaaaaggtaatgctggcatggcttactgggaccctaagtgtggcgaagggactctgctccagtgaactggcgagtgtggaacctcctgacaccttctgaggacctcctgcctgccatgttgctgtggagctcgcactcctcaggcatcccctgatgttgagtgatacaaactctatcaccggaatcgatgctgctgcaatgacaagacttctttctggttttcagattctaaagtttaaaacaacgacaacaacaggagcgcttgaaagttacggtgcttctccctctccagtgtggactcgctgatgtttggaaagattggacttgctacagaaggtctttccacagtgatgacaccagtagggcttttccccggtgtggattctgtggtgtttattgaagttggagctgtggttgaaggctttcccacactccttacacttatatggcttctctccggtgtggagtctctggtgggagctgaggcccgcatgctgactgaagctcttcccacattcgttacactgataaggcttctccccagtgtggatccgatagtgacgaatgaggctgcctttcccgctgaaagccttgccacaatctttgcactgatatggcgcctcttctgtgtgcattctctgatgtttaagaaggtctgagctctgcccaaaagcttttccacacttacagtcatagggccggtccaccaagtgtgttctgtagtggagggtgaggtttgagctgtggctgaaagctttcccacacttggtgcacacgtaaggtttctccccagtgtgtgttctcctgtgtttggtgagatttgagctattactaaaggctttgccacattcagcacatatataacgtctctctcctggggtaggtttagtaggaactgattctctacctttcttggagcctgcctcttgaagagggggttttgttcctttttcattttcaaggtttacgcactgcctctctaagctggcctcaggtttattggcgataatcacagaaattatatcccctttgagcccctctgcttcagaacctttctgctcatctgctgattcctcgtgctgggtactcaatctgcaatctgaaacaataagcagattaaggatacttcagttgtttcttgttctgaggaagaaactgttaccagagagatagaaccatcaggtgagactgatggtttctgaagggtgactaaacagagctcatgatagcgcatagatacaagtaaatcagcatccaatctagtttacaatactgcacttctttttttttttgagatggagtctcgctgtcagcaggctggaatgcagtgagntgagatgcnccnntgcactccagcctgngngacagagtgaaattccgtcttaagaaaaataaagaaaatttaaaaataccgggcgcggtggctcacgcctgtaatcccagctctcagggaggcaacaggtgggaggatagcttgagcccaggagttccagacctgcctgggcaatatagcgagaccctgttctccacaaaaaggaaaaaaaaaaaattaaaaaataaaagacaataaaagactagtcccagttgccacatttcttctcactgtacctgggtactcactgaaatactagctcccatctttctgtctacaggaggttttttcgaattatctttgaaccttgaacttttgcttctgcagtgcttccggtcg

SEQ ID NO: 290737 - DNA, 2819 bp, Homo sapiens
  misc_feature (2441)..(2441): n is a, c, g, or t
  misc_feature (2450)..(2450): n is a, c, g, or t
  misc_feature (2453)..(2454): n is a, c, g, or t
  misc_feature (2469)..(2469): n is a, c, g, or t
  misc_feature (2471)..(2471): n is a, c, g, or t
tgcatcatcgccgctgactgcatcaacgccgcgctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggtgagctgtggttccgtttatccttttcctttccattttctgtgcaatgacatcccattcagagctttaaaccctgatctcctccatcaggcccatggttctgtcctgctgaatcatggaccctcaccttctatcttggactcctgtctctcttcctccaccctgtcctcccttcctcccttcccaaatgtgcatttttcaccccatcctcagtgatttttttggtgccgccattcacattcctcaccctgaaattgcatgccagcacgtgttgtttcaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactgaagctcttcccacattcgttacactgataaggcttctccccagtgtggatccgatagtgacgaatgaggctgcctttcccgctgaaagccttgccacaatctttgcactgatatggcgcctcttctgtgtgcattctctgatgtttaagaaggtctgagctctgcccaaaagcttttccacacttacagtcatagggccggtccaccaagtgtgttctgtagtggagggtgaggtttgagctgtggctgaaagctttcccacacttggtgcacacgtaaggtttctccccagtgtgtgttctcctgtgtttggtgagatttgagctattactaaaggctttgccacattcagcacatatataacgtctctctcctggggtaggtttagtaggaactgattctctacctttcttggagcctgcctcttgaagagggggttttgttcctttttcattttcaaggtttacgcactgcctctctaagctggcctcaggtttattggcgataatcacagaaattatatcccctttgagcccctctgcttcagaacctttctgctcatctgctgattcctcgtgctgggtactcaatctgcaatctgaaacaataagcagattaaggatacttcagttgtttcttgttctgaggaagaaactgttaccagagagatagaaccatcaggtgagactgatggtttctgaagggtgactaaacagagctcatgatagcgcatagatacaagtaaatcagcatccaatctagtttacaatactgcacttctttttttttttgagatggagtctcgctgtcagcaggctggaatgcagtgagntgagatgcnccnntgcactccagcctgngngacagagtgaaattccgtcttaagaaaaataaagaaaatttaaaaataccgggcgcggtggctcacgcctgtaatcccagctctcagggaggcaacaggtgggaggatagcttgagcccaggagttccagacctgcctgggcaatatagcgagaccctgttctccacaaaaaggaaaaaaaaaaaattaaaaaataaaagacaataaaagactagtcccagttgccacatttcttctcactgtacctgggtactcactgaaatactagctcccatctttctgtctacaggaggttttttcgaattatctttgaaccttgaacttttgcttctgcagtgcttccggtcg

SEQ ID NO: 290738 - DNA, 1191 bp, Homo sapiens
tgcatcatcgccgctgactgcatcaacgccgcgctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggtgagctgtggttccgtttatccttttcctttccattttctgtgcaatgacatcccattcagagctttaaaccctgatctcctccatcaggcccatggttctgtcctgctgaatcatggaccctcaccttctatcttggactcctgtctctcttcctccaccctgtcctcccttcctcccttcccaaatgtgcatttttcaccccatcctcagtgatttttttggtgccgccattcacattcctcaccctgaaattgcatgccagcacgtgttgtttcaggagctggtaacctttgaggatgtagctgtgtacttcatccggaaggagtggaagcgtttggaacctgctcagagggacctctatagagatgtgatgctggagaattacgggaatgtgttctcactggagtaaggagttatgccttgtcaacaaaactcgctggtgtttctttgcttcttcgtttgctagtaacaatctagtcactgaaaagagctgtttcagcagattttttttttgaggtgcaatggcacaatctttgctcagtgcaacatccatctcccagattcaagtgttcccaggttctcacctctgcctcccaagtagctgggactacaggcacgcaccaccacaccaggctaatttttgtatttgttttgtttttttttgttttagtagagacggggtttcaccagcctgggcaacatagcaaaacccacctcaaaa

SEQ ID NO: 290739 - DNA, 2405 bp, Homo sapiens
  misc_feature (29)..(29): n is a, c, g, or t
  misc_feature (2027)..(2027): n is a, c, g, or t
  misc_feature (2036)..(2036): n is a, c, g, or t
  misc_feature (2039)..(2040): n is a, c, g, or t
  misc_feature (2055)..(2055): n is a, c, g, or t
  misc_feature (2057)..(2057): n is a, c, g, or t
agtcgctttcgacagacgctgggataatntgcgcgcctcttaagccagtccaggtgagctgtggttccgtttatccttttcctttccattttctgtgcaatgacatcccattcagagctttaaaccctgatctcctccatcaggcccatggttctgtcctgctgaatcatggaccctcaccttctatcttggactcctgtctctcttcctccaccctgtcctcccttcctcccttcccaaatgtgcatttttcaccccatcctcagtgatttttttggtgccgccattcacattcctcaccctgaaattgcatgccagcacgtgttgtttcaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactgaagctcttcccacattcgttacactgataaggcttctccccagtgtggatccgatagtgacgaatgaggctgcctttcccgctgaaagccttgccacaatctttgcactgatatggcgcctcttctgtgtgcattctctgatgtttaagaaggtctgagctctgcccaaaagcttttccacacttacagtcatagggccggtccaccaagtgtgttctgtagtggagggtgaggtttgagctgtggctgaaagctttcccacacttggtgcacacgtaaggtttctccccagtgtgtgttctcctgtgtttggtgagatttgagctattactaaaggctttgccacattcagcacatatataacgtctctctcctggggtaggtttagtaggaactgattctctacctttcttggagcctgcctcttgaagagggggttttgttcctttttcattttcaaggtttacgcactgcctctctaagctggcctcaggtttattggcgataatcacagaaattatatcccctttgagcccctctgcttcagaacctttctgctcatctgctgattcctcgtgctgggtactcaatctgcaatctgaaacaataagcagattaaggatacttcagttgtttcttgttctgaggaagaaactgttaccagagagatagaaccatcaggtgagactgatggtttctgaagggtgactaaacagagctcatgatagcgcatagatacaagtaaatcagcatccaatctagtttacaatactgcacttctttttttttttgagatggagtctcgctgtcagcaggctggaatgcagtgagntgagatgcnccnntgcactccagcctgngngacagagtgaaattccgtcttaagaaaaataaagaaaatttaaaaataccgggcgcggtggctcacgcctgtaatcccagctctcagggaggcaacaggtgggaggatagcttgagcccaggagttccagacctgcctgggcaatatagcgagaccctgttctccacaaaaaggaaaaaaaaaaaattaaaaaataaaagacaataaaagactagtcccagttgccacatttcttctcactgtacctgggtactcactgaaatactagctcccatctttctgtctacaggaggttttttcgaattatctttgaaccttgaacttttgcttctgcagtgcttccggtcg

SEQ ID NO: 290740 - DNA, 2119 bp, Homo sapiens
  misc_feature (1741)..(1741): n is a, c, g, or t
  misc_feature (1750)..(1750): n is a, c, g, or t
  misc_feature (1753)..(1754): n is a, c, g, or t
  misc_feature (1769)..(1769): n is a, c, g, or t
  misc_feature (1771)..(1771): n is a, c, g, or t
gtttaggctaggtacgaggctgcgtggtgaatcggccgagggtccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactgaagctcttcccacattcgttacactgataaggcttctccccagtgtggatccgatagtgacgaatgaggctgcctttcccgctgaaagccttgccacaatctttgcactgatatggcgcctcttctgtgtgcattctctgatgtttaagaaggtctgagctctgcccaaaagcttttccacacttacagtcatagggccggtccaccaagtgtgttctgtagtggagggtgaggtttgagctgtggctgaaagctttcccacacttggtgcacacgtaaggtttctccccagtgtgtgttctcctgtgtttggtgagatttgagctattactaaaggctttgccacattcagcacatatataacgtctctctcctggggtaggtttagtaggaactgattctctacctttcttggagcctgcctcttgaagagggggttttgttcctttttcattttcaaggtttacgcactgcctctctaagctggcctcaggtttattggcgataatcacagaaattatatcccctttgagcccctctgcttcagaacctttctgctcatctgctgattcctcgtgctgggtactcaatctgcaatctgaaacaataagcagattaaggatacttcagttgtttcttgttctgaggaagaaactgttaccagagagatagaaccatcaggtgagactgatggtttctgaagggtgactaaacagagctcatgatagcgcatagatacaagtaaatcagcatccaatctagtttacaatactgcacttctttttttttttgagatggagtctcgctgtcagcaggctggaatgcagtgagntgagatgcnccnntgcactccagcctgngngacagagtgaaattccgtcttaagaaaaataaagaaaatttaaaaataccgggcgcggtggctcacgcctgtaatcccagctctcagggaggcaacaggtgggaggatagcttgagcccaggagttccagacctgcctgggcaatatagcgagaccctgttctccacaaaaaggaaaaaaaaaaaattaaaaaataaaagacaataaaagactagtcccagttgccacatttcttctcactgtacctgggtactcactgaaatactagctcccatctttctgtctacaggaggttttttcgaattatctttgaaccttgaacttttgcttctgcagtgcttccggtcg

SEQ ID NO: 290741 - DNA, 664 bp, Homo sapiens
tgcatcatcgccgctgactgcatcaacgccgcgctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtggtgaggaataaggactcattcattcttttactcagtcattctgcaatcatccattgaaatcgctcacttaccaggtactaggctaactactagaatccagatgtgaataagacacactcttcgccattcagtaactcacagcctagtggggaagctgaccgaacagtaatcaatgacagcttgataggtttgataattgaggcagattgttttgttttgttttgttttttttgagatggagtcttgctctgttgctcaggctagagtgcagtggcacaatctcggc

SEQ ID NO: 290742 - DNA, 341 bp, Homo sapiens
tgatgctggagaattacgggaatgtgttctcactggagtaaggagttatgccttgtcaacaaaactcgctggtgtttctttgcttcttcgtttgctagtaacaatctagtcactgaaaagagctgtttcagcagattttttttttgaggtgcaatggcacaatctttgctcagtgcaacatccatctcccagattcaagtgttcccaggttctcacctctgcctcccaagtagctgggactacaggcacgcaccaccacaccaggctaatttttgtatttgttttgtttttttttgttttagtagagacggggtttcaccatgttggccaggctggtctca

SEQ ID NO: 290743 - DNA, 376 bp, Homo sapiens
ggcggctgcgctcctaaaggccaagtcccaggtgagctgtggttccgtttatccttttcctttccattttctgtgcaatgacatcccattcagagctttaaaccctgatctcctccatcaggcccatggttctgtcctgctgaatcatggaccctcaccttctatcttggactcctgtctctcttcctccaccctgtcctcccttcctcccttcccaaatgtgcatttttcaccccatcctcagtgatttttttggtgccgccattcacattcctcaccctgaaattgcatgccagcacgtgttgtttcaggagctggtaacctttgaggatgtagctgtgtacttcatccggaaggagtggaagcgtttggaacc

SEQ ID NO: 290744 - DNA, 412 bp, Homo sapiens
ccgggtgaaatgggcagagtggcgcttacccgggatggcggtgaagcgggaccgggaggtcatcgtgacaaagggtggcatgaggtacctggccttgacgccctccccggctagacggtccagattgggggtgtccacatcctgatcctagtcccagcggaagccctggaaggagatcagcagcagctaaactcctggagggcagagccatgcctgccattttcatcattgcattaccaccacccagcacagtgcctggtacaaaagagttgctcaataaataaatcaggatgaatggataaatacacggataggcactttgaactacagatgagcttaaatactttgtgtttttcttagtcaaacatgtgcaattaagcatgtgataaattatatgatgaccacacctgtg

SEQ ID NO: 290745 - DNA, 318 bp, Homo sapiens
ctccagatgcaagccctcatggggcttcagataccatgaggaatgggcgtccctgcaatattgtcatggctgtcaaaagtgttattggagctggaaactcctggagggcagagccatgcctgccattttcatcattgcattaccaccacccagcacagtgcctggtacaaaagagttgctcaataaataaatcaggatgaatggataaatacacggataggcactttgaactacagatgagcttaaatactttgtgtttttcttagtcaaacatgtgcaattaagcatgtgataaattatatgatgaccacacctgtg

SEQ ID NO: 290746 - DNA, 1307 bp, Homo sapiens
caacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcgattaacaaaatatattgtgttactatgtttcactaaatttttgaaggctgtgggacttttcgaatcatatgatctcctaaaagctgttcacattgttcagttcatttttatattaaaacttgggactgcattttttatggttttgtttcaaaagccattttcttctgggaaaactattaccaaacaccagataattggatcactaaaaattcctggtagaaaagaatttaaagacaaaaagttaaatgatcctaggaaactagtgggaaactgagaaatcataaaattgtactctgaagaaaaagatttcaaaatctaccagcagacaagaatatagataatggaaaacagaatactgtcctttttttttttctttctttttttgagaaagagtcttgctccatcgcccaggctgcagtgcagtgacacgatcttgtctcactgcaacctctgcctcccgggttcaagcgattctcctgcctcagcctcctgagtagctggaattacaggcacccaccaccacacccagctcatttttgtatttttagtagagacggggcttcattcaccacattggccagcctggtcttgaactcctgacctcaggtgatctgcctgcctcggcctcacaaagtgctaggattacaggcatgagccacagcacccggcccagaataagaatactgtcttggaaatctagacttagtcaagggatcttatgttttctatttacaaaatatgtaatgatttcacctttaaaatatttgttattattatctttctgtattttatttaaaatttggatatatagcaaaatatatgtgactgaaatttttaatttttttgtttccatttatagtggatcaaaatatttaaacatgcagttgctgggtgtattatttcactcttgtggttttttggcctcactctttgtggaccactaaggtaaataaaaatgcatattttgaatgtgtgttt

SEQ ID NO: 290747 - DNA, 644 bp, Homo sapiens
caacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcgattaacaaaatatattgtgttactatgtttcactaaatttttgaaggctgtgggacttttcgaatcatatgatctcctaaaagctgttcacattgttcagttcatttttatattaaaacttgggactgcattttttatggttttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcat

SEQ ID NO: 290748 - DNA, 1184 bp, Homo sapiens
caacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcggactgcattttttatggttttgtttcaaaagccattttcttctgggaaaactattaccaaacaccagataattggatcactaaaaattcctggtagaaaagaatttaaagacaaaaagttaaatgatcctaggaaactagtgggaaactgagaaatcataaaattgtactctgaagaaaaagatttcaaaatctaccagcagacaagaatatagataatggaaaacagaatactgtcctttttttttttctttctttttttgagaaagagtcttgctccatcgcccaggctgcagtgcagtgacacgatcttgtctcactgcaacctctgcctcccgggttcaagcgattctcctgcctcagcctcctgagtagctggaattacaggcacccaccaccacacccagctcatttttgtatttttagtagagacggggcttcattcaccacattggccagcctggtcttgaactcctgacctcaggtgatctgcctgcctcggcctcacaaagtgctaggattacaggcatgagccacagcacccggcccagaataagaatactgtcttggaaatctagacttagtcaagggatcttatgttttctatttacaaaatatgtaatgatttcacctttaaaatatttgttattattatctttctgtattttatttaaaatttggatatatagcaaaatatatgtgactgaaatttttaatttttttgtttccatttatagtggatcaaaatatttaaacatgcagttgctgggtgtattatttcactcttgtggttttttggcctcactctttgtggaccactaaggtaaataaaaatgcatattttgaatgtgtgttt

SEQ ID NO: 290749 - DNA, 876 bp, Homo sapiens
ccgtattgtttaggagtcaactgtatattcttactttgcccatgtctgagtaggaaaaaggaagggaggttaattgattgcttgtgttagatgaaatacgcgtgaatcctttatgagatttataagaacatcaacaaacagtaacttgggcaaagaattccaaagacatttctttagtcctctttcaataagcacattttctgacattaggtagtaataaaagacagtgctcatatcgaggcttactacatgcttttggaattgcaggattttgttatttaaatttagactgtgattctctgagtaactgtatatattgctttaccccaaatccactcaaatcctctgagcagcagtccttcgggtctaagtgccaccttcacgagacaccccgcacacaggtgccgccagcagtgtggctgaccctgctagctctccacccacggtccactctccacttcaaccttattaacagaaacttgattgcttccaaatggcaatcaactcagccaaagatctacatttcccaggctcccatgtagcaagggacagctatgtcatacagttctgcccgatgagataaaaccagacatattctagggacctctgagaaaattctgctttcctgatttctgctgccccttcttccttgaagtttcatttcacttcttctaggctggaacacagatgtggggctggaagtggagcagccccttttagccatgaggcccaaagccacatgctaaggatggtgaagcaggggatagaaagagcctgtgtctttgctgacttccttaagccacggcaccagcctgggcctgccctactctggacatctaaatgtgtaaggagaaataaacttcattcgttttatta

SEQ ID NO: 290750 - DNA, 552 bp, Homo sapiens
tgtggagtgcagctgaaatgaccgctactgctccttcacagtatatttacatgagcttcctgtggacatcagcaccatttaaaattaagtcttctaggctggaacacagatgtggggctggaagtggagcagccccttttagccatgaggcccaaagccacatgctaaggatggtgaagcaggggatagaaagagcctgtgtctttgctgacttccttaagccacggcaccagcctgggcctgccctactctggacatctaaatgtcaggagctaagaatcaagtcagtctagaggtgttcgttgccatgtggagagatccttcccaagaagaaagatgctacaaagtgtcctggaaatcctctttgcccatccagatccaccctccctagcctgctctgtacctcaggaagctgcttttcatggttcacataaaccaggctcctgtaccctccagataggtccatcctatgggtggtaccagcaggagaccagagagatgaaggagggaaaaaaagaacattaggggttgaattgtatcaccccaaaattc

SEQ ID NO: 290751 - DNA, 683 bp, Homo sapiens
  misc_feature (611)..(611): n is a, c, g, or t
  misc_feature (622)..(623): n is a, c, g, or t
  misc_feature (635)..(636): n is a, c, g, or t
  misc_feature (648)..(648): n is a, c, g, or t
  misc_feature (651)..(651): n is a, c, g, or t
  misc_feature (653)..(653): n is a, c, g, or t
  misc_feature (665)..(666): n is a, c, g, or t
  misc_feature (676)..(676): n is a, c, g, or t
tgtggagtgcagctgaaatgaccgctactgctccttcacagtatatttacatgagcttcctgtggacatcagcaccatttaaaattaaggctggactgcagtggcgtgatctcggctcactgcaacttctgcctcccgagctcaagtgatccttccacctcggcctccccagtacccgggactacaggcacacaccaccacgcctggctaatttttgtattttttgtagagatggggttgcatcatgttgcccaggctggtcttgaactcctaagctcaagcagtctgcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttgggcttcaagtggcctcataagttgcttgcatttaaattcacggaattcattggaccaatangttacattttnngtccttttttgnnttgggtcatctngtnancagtgggggccnnattactgctnctttgta

SEQ ID NO: 290752 - DNA, 630 bp, Homo sapiens
  misc_feature (558)..(558): n is a, c, g, or t
  misc_feature (569)..(570): n is a, c, g, or t
  misc_feature (582)..(583): n is a, c, g, or t
  misc_feature (595)..(595): n is a, c, g, or t
  misc_feature (598)..(598): n is a, c, g, or t
  misc_feature (600)..(600): n is a, c, g, or t
  misc_feature (612)..(613): n is a, c, g, or t
  misc_feature (623)..(623): n is a, c, g, or t
tgtggagtgcagctgaaatgaccgctactgctccttcacagtatatttacatgagcttcctgtggacatcagcaccatttaaaattaaggctggactgcagtggcgtgatctcggctcactgcaacttctgcctcccgagctcaagtgatccttccacctcggcctccccagtacccgggactacaggcacacaccaccacgcctggctaatttttgtattttttgtagagatggggttgcatcatgttgcccaggctggtcttgaactcctaagctcaagcagtctgcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagtgcttgcatttaaattcacggaattcattggaccaatangttacattttnngtccttttttgnnttgggtcatctngtnancagtgggggccnnattactgctnctttgta

SEQ ID NO: 290753 - DNA, 298 bp, Homo sapiens
tgtggagtgcagctgaaatgaccgctactgctccttcacagtatatttacatgagcttcctgtggacatcagcaccatttaaaattaagtcttctaggctggaacacagatgtggggctggaagtggagcagccccttttagccatgaggcccaaagccacatgctaaggatggtgaagcaggggatagaaagagcctgtgtctttgctgacttccttaagccacggcaccagcctgggcctgccctactctggacatctaaatgtgtaaggagaaataaacttcattcgttttatta

SEQ ID NO: 290754 - DNA, 821 bp, Homo sapiens
ccgtattgtttaggagtcaactgtatattcttactttgcccatgtctgagtaggaaaaaggaagggaggttaattgattgcttgtgttagatgaaatacgcgtgaatcctttatgagatttataagaacatcaacaaacagtaacttgggcaaagaattccaaagacatttctttagtcctctttcaataagcacattttctgacattaggtagtaataaaagacagtgctcatatcgaggcttactacatgcttttggaattgcaggattttgttatttaaatttagactgtgattctctgagtaactgtatatattgctttaccccaaatccactcaaatcctctgagcagcagtccttcgggtctaagtgccaccttcacgagacaccccgcacacaggtgccgccagcagtgtggctgaccctgctagctctccacccacggtccactctccacttcaaccttattaacagaaacttgattgcttccaaatggcaatcaactcagccaaagatctacatttcccaggctcccatgtagcaagggacagctatgtcatacagttctgcccgatgagataaaaccagacatattctagggacctctgagatcttctaggctggaacacagatgtggggctggaagtggagcagccccttttagccatgaggcccaaagccacatgctaaggatggtgaagcaggggatagaaagagcctgtgtctttgctgacttccttaagccacggcaccagcctgggcctgccctactctggacatctaaatgtgtaaggagaaataaacttcattcgttttatta

SEQ ID NO: 290755 - DNA, 479 bp, Homo sapiens
taacatgaggtgatatctttcctggtttgactttcatcaaaaattaaacgacagaccataccgacgctttgaaaacgtgactgagctggtgcacaaaacaatggtgcctagaattttgaattgtgcaatgttgtgcatggccgcggatatgtggggccttgtggttccaagagcctgtctcaggtgtaccggccctcatcactgggcttcagaggttcaatctgcaaggaggcatctcctgccaggaaattggaagcaaaggccactcggcccttctgttcctcagtcaagttattgtagacatgacgactggagtaagtgatcacctgtgggatagaccgaggcagagtcaagcagcgtaactctcagcctgcctttcctgatggtgtgaagaagaggaaagggagtactcccagtggcacaaagtagtcaagcctggggctgagagtccaagagacctctgttctaaataaaagtta

SEQ ID NO: 290756 - DNA, 2300 bp, Homo sapiens
tcgacagtccccgctctgagagggagggacagagagcgaactgtcagatcggagcgagagcgggcgcccgagagagggagagagagagagggagggagaggaaaagtgagagagggaaagagagcgcgaacgagggcgcagagcgagctcctgctgcaactctgctccagcacggccagcgccagcgcccgccgtcggtgcactctacgagccgtgcagcgtgcccactggagttgttgtgtatcaaggatcgatcccctatatgcacacacacacctccacctccaccaatgcactcttcttcctcctccttctccagacaactgctgggaaaaaaataaaacaccaaccccaaccgtcagcaacaaggtaacagagcgattcgacatcattttttttcctgttcaattttttccttgttatatttgtttcctaatttctgcccaaaaggaaagatgtcgcatcagactgtgactgttgcgaggagaatgaaaaaggactcttgtttcagaggcaaccaagagctccggcaatagcaacttcagagaaatgcaccatcgcaagaagttttcctaggacagaacaaaacttgaaacgagaggaccagagggggagagcaggagccagcctcccctctccgcactcgcgagcagccagcagcaccacgccttcaaggacgaaaaagttttactactctaagggaaaacgagtgaaatgtgttcctgaggaggagaggagaggagaggagagagcggacaagagaaggagcgggccggttgctggtcatccgtaatttggctaaggaagaaaggagcagcttctttctttgttatctcccgtgaaaccttcacttagcaggtggacggagccccgcgaccgggcagagtccgggcccatccgccgccctcccctccacccagagacaggcatgcccgcccttggaggagaaaacgcgggagaaacggaccaaggaggcatttttgcagtccaaggaaggaggggccaaaaaataaaaagcataataaacacccagactgttttgtatacatatataacaaacaaaaccggaagagaaaaagggggcgatcatgagatctcgttcatactgtggtggtgtttcgtttttgtttttgtttttaaagaagggtgaagatgcctgacgcacgaaaactgcactcgtgaggtttttccaccctgagatgacctacacggcagcggtggacagcacctgcctcgtcttctcctctttgaaaaaaagagagagagagagtcccctttcctttcactttctccctccaaaacagctgcctaaagagatccacggaaactttatttcctgggagcgacctgagagaaaacagaggcaccaggttccatcaggggacgacaccgtgctctgggaccctgtttttcttggccatattaaagtcatttggaaacaaatcaactctgaaatgggaaggaggggggaaaaacagtctccaagaaaaaaataattatattgacagcttctgaaactaacagactgaatagcaaagccaaaagaaaagtatcctcaaagtaaccttggaaataaaaggatcgggaaggagcagagggagagggggaacgtccgctgaggagtggcgagaggccccggccgagtcgggtcgcgggcgggcgggcgaactgggagcagagcgggggcccagccagcgaggccgccgagccaggcccggccgcgtacccaggctttgacggctgccattcagggtggacgatgcctaaagattccaccgctaatattttttttattaatattttttattttttatttctggactgactcagataaaggaatttagaaagactgagcaccagccgctgcacttctctggacttctctcctcaatccgttgccaactttgattgaatgggtgctgtggatgtgattatataatactgccatttccaagcagtgtttttggtaggttttaataaacagacttttcaaaagacggcaatatagaattgttagatccgttgttgatctaaaaatatttgctttatattttcattaaatgacttcttttaatattttattcagaatacttatgaactgctgcaaaacggtaatttatttttccccagatcttgtattacgtgtttttttcagacgagcacaaatcaaaatgaaatgaaaatatggacagttgttaggtaataagggtatcttttgatgtgatcatttgattgtaatttaatttgagtagtgattccgtaagagctgatcgagaaaataaatttgttagaatgaaata

SEQ ID NO: 290757 - DNA, 1489 bp, Homo sapiens
gccgccgccgccgccgccgccgccgccgctgccgccgccgcgccgaccctgcacctgggccgctccgggctccagcccaggcccatccgccgccctcccctccacccagagacaggcatgcccgcccttggaggagaaaacgcgggagaaacggaccaaggaggcatttttgcagtccaaggaaggaggggccaaaaaataaaaagcataataaacacccagactgttttgtatacatatataacaaacaaaaccggaagagaaaaagggggcgatcatgagatctcgttcatactgtggtggtgtttcgtttttgtttttgtttttaaagaagggtgaagatgcctgacgcacgaaaactgcactcgtgaggtttttccaccctgagatgacctacacggcagcggtggacagcacctgcctcgtcttctcctctttgaaaaaaagagagagagagagtcccctttcctttcactttctccctccaaaacagctgcctaaagagatccacggaaactttatttcctgggagcgacctgagagaaaacagaggcaccaggttccatcaggggacgacaccgtgctctgggaccctgtttttcttggccatattaaagtcatttggaaacaaatcaactctgaaatgggaaggaggggggaaaaacagtctccaagaaaaaaataattatattgacagcttctgaaactaacagactgaatagcaaagccaaaagaaaagtatcctcaaagtaaccttggaaataaaaggatcgggaaggagcagagggagagggggaacgtccgctgaggagtggcgagaggccccggccgagtcgggtcgcgggcgggcgggcgaactgggagcagagcgggggcccagccagcgaggccgccgagccaggcccggccgcgtacccaggctttgacggctgccattcagggtggacgatgcctaaagattccaccgctaatattttttttattaatattttttattttttatttctggactgactcagataaaggaatttagaaagactgagcaccagccgctgcacttctctggacttctctcctcaatccgttgccaactttgattgaatgggtgctgtggatgtgattatataatactgccatttccaagcagtgtttttggtaggttttaataaacagacttttcaaaagacggcaatatagaattgttagatccgttgttgatctaaaaatatttgctttatattttcattaaatgacttcttttaatattttattcagaatacttatgaactgctgcaaaacggtaatttatttttccccagatcttgtattacgtgtttttttcagacgagcacaaatcaaaatgaaatgaaaatatggacagttgttaggtaataagggtatcttttgatgtgatcatttgattgtaatttaatttgagtagtgattccgtaagagctgatcgagaaaataaatttgttagaatgaaata

SEQ ID NO: 290758 - DNA, 2071 bp, Homo sapiens
  misc_feature (251)..(251): n is a, c, g, or t
atggccacggcggcttctaacccctacctgccggggaacagcctgctcgcggccggctctattgtgcactcggacgcggcaggggctggcggcggcgggggtggcggcggcggcggcggcgggggcggcgcagggggcgggggcggcggcatgcagccgggcagcgccgccgtgacctcgggcgcctaccggggggacccgtcctctgtcaagatggtccagagcgacttcatgcagggggccatggccgncagcaacggcggccatatgctgagccacgcgcaccagtgggtcacagccctgccccacgccgccgccgccgccgccgctgccgccgccgccgccgtggaggcgagctcgccgtggtcgggcagcgccgtgggcatggctggcagcccccagcagccaccgcagccgccgccgccaccgccgcagggccccgacgtgaagggcggcgccgggcgcgacgacctgcacgcgggcacagcgctgcaccaccgcgggccgccgcacctcggacccccgccgccgcccccacaccagggccaccctgggggctggggggcggccgccgctgccgcagccgcagccgccgccgccgccgccgccgcgcacctcccgtccatggccgggggcctgggccgctccgggctccagcccaggcccatccgccgccctcccctccacccagagacaggcatgcccgcccttggaggagaaaacgcgggagaaacggaccaaggaggcatttttgcagtccaaggaaggaggggccaaaaaataaaaagcataataaacacccagactgttttgtatacatatataacaaacaaaaccggaagagaaaaagggggcgatcatgagatctcgttcatactgtggtggtgtttcgtttttgtttttgtttttaaagaagggtgaagatgcctgacgcacgaaaactgcactcgtgaggtttttccaccctgagatgacctacacggcagcggtggacagcacctgcctcgtcttctcctctttgaaaaaaagagagagagagagtcccctttcctttcactttctccctccaaaacagctgcctaaagagatccacggaaactttatttcctgggagcgacctgagagaaaacagaggcaccaggttccatcaggggacgacaccgtgctctgggaccctgtttttcttggccatattaaagtcatttggaaacaaatcaactctgaaatgggaaggaggggggaaaaacagtctccaagaaaaaaataattatattgacagcttctgaaactaacagactgaatagcaaagccaaaagaaaagtatcctcaaagtaaccttggaaataaaaggatcgggaaggagcagagggagagggggaacgtccgctgaggagtggcgagaggccccggccgagtcgggtcgcgggcgggcgggcgaactgggagcagagcgggggcccagccagcgaggccgccgagccaggcccggccgcgtacccaggctttgacggctgccattcagggtggacgatgcctaaagattccaccgctaatattttttttattaatattttttattttttatttctggactgactcagataaaggaatttagaaagactgagcaccagccgctgcacttctctggacttctctcctcaatccgttgccaactttgattgaatgggtgctgtggatgtgattatataatactgccatttccaagcagtgtttttggtaggttttaataaacagacttttcaaaagacggcaatatagaattgttagatccgttgttgatctaaaaatatttgctttatattttcattaaatgacttcttttaatattttattcagaatacttatgaactgctgcaaaacggtaatttatttttccccagatcttgtattacgtgtttttttcagacgagcacaaatcaaaatgaaatgaaaatatggacagttgttaggtaataagggtatcttttgatgtgatcatttgattgtaatttaatttgagtagtgattccgtaagagctgatcgagaaaataaatttgttagaatgaaata

SEQ ID NO: 290759 - DNA, 1567 bp, Homo sapiens
  misc_feature (251)..(251): n is a, c, g, or t
atggccacggcggcttctaacccctacctgccggggaacagcctgctcgcggccggctctattgtgcactcggacgcggcaggggctggcggcggcgggggtggcggcggcggcggcggcgggggcggcgcagggggcgggggcggcggcatgcagccgggcagcgccgccgtgacctcgggcgcctaccggggggacccgtcctctgtcaagatggtccagagcgacttcatgcagggggccatggccgncagcaacggcggccatatgctgagccacgcgcaccagtgggtcacagccctgccccacgccgccgccgccgccgccgctgccgccgccgccgccgtggaggcgagctcgccgtggtcgggcagcgccgtgggcatggctggcagcccccagcagccaccgcagccgccgccgccaccgccgcagggccccgacgtgaagggcggcgccgggcgcgacgacctgcacgcgggcacagcgctgcaccaccgcgggccgccgcacctcggacccccgccgccgcccccacaccagggccaccctgggggctggggggcggccgccgctgccgcagccgcagccgccgccgccgccgccgccgcgcacctcccgtccatggccgggggccagcagccgccgccgcagagtctgctctactcgcagcccggaggcttcacggtgaacggcatgctgagcgcgccaccggggcccggcggcggcggcggcggcgcgggcggtggagcccagagcttggtgcacccggggctggtgcgcggggacacgccagagctggccgagcaccaccaccaccaccaccaccacgcgcatcctcacccgccgcacccgcaccacgcgcagggacccccgcaccacggcggcggcggcggcggcgcggggcctggactcaacagccacgacccgcactcggacgaggacacgccgacgtcggacgacctggagcagttcgccaagcagttcaagcagcggcgcatcaagctgggcttcacgcaggccgacgtggggttggcgctgggcacactctacggcaacgtgttctcgcagaccaccatctgccgcttcgaggccctgcagctgagcttcaagaacatgtgcaagctcaagccgctgctgaacaagtggctggaggaggcggactcaagcaccggcagccccacaagcatcgacaagatcgcggcgcagggccgcaagcgcaagaagcggacctctatcgaggtgagcgtcaagggcgcgctggagagccacttcctcaagtgccccaagccctccgcgcaggagatcaccaacctggccgacagcctgcagctcgagaaggaggtggtgcgggtctggttctgcaatcggcgccaaaaggagaagcgcatgacgccgcccgggatccaacagcagacgcccgacgacgtctactcgcaggtgggcaccgtgagcgccgacacgccgccgcctcaccacgggctgcagacgagcgttcagtgaagccagggcgcagagcgaagagggccgccgccgccgccgcctccgcagccgccgtcagcaccgc

SEQ ID NO: 290760 - DNA, 975 bp, Homo sapiens
tcgacagtccccgctctgagagggagggacagagagcgaactgtcagatcggagcgagagcgggcgcccgagagagggagagagagagagggagggagaggaaaagtgagagagggaaagagagcgcgaacgagggcgcagagcgagctcctgctgcaactctgctccagcacggccagcgccagcgcccgccgtcggtgcactctacgagccgtgcagcgtgcccactggagttgttgtgtatcaaggatcgatcccctatatgcacacacacacctccacctccaccaatgcactcttcttcctcctccttctccagacaactgctgggaaaaaaataaaacaccaaccccaaccgtcagcaacaaggtaacagagcgattcgacatcattttttttcctgttcaattttttccttgttatatttgtttcctaatttctgcccaaaaggaaagatgtcgcatcagactgtgactgttgcgaggagaatgaaaaaggactcttgtttcagaggcaaccaagagctccggcaatagcaacttcagagaaatgcaccatcgcaagaagttttcctaggacagaacaaaacttgaaacgagaggaccagagggggagagcaggagccagcctcccctctccgcactcgcgagcagccagcagcaccacgccttcaaggacgaaaaagttttactactctaagggaaaacgagtgaaatgtgttcctgaggaggagaggagaggagaggagagagcggacaagagaaggagcgggccggttgctggtcatccgtaatttggctaaggaagaaaggagcagcttctttctttgttatctcccgtgaaaccttcacttagcaggtggacggagccccgcgaccgggcagagtccgggctcgcccgaggacaggaggaggagcgggagcccgcgcgtcccgggagagcgccccgagtgcaggtccccgccccgcccggcga

SEQ ID NO: 290761 - DNA, 357 bp, Homo sapiens
  misc_feature (280)..(280): n is a, c, g, or t
  misc_feature (334)..(335): n is a, c, g, or t
tgaagctgagtgagcactaaaggcctgtttagggtcgaggctgtgacgggcctcgatgaggggcccacagccttagcagactcaggaggcaaaaccaggggcagatgattagaaatgcgtgggtggggggacttgcctggggtccatggtgggggcaggggccttgcctggggtccatgaggaatagtcggcttgcccggggtcagtggggggtggaaggggcagtgggcttacccggggtgaggggatgggggggcagtgggcttgcctagggtcagtnagttgggggacgggaggggcagtgggcttacccggggtgaggggatgggggggnngtgggcttgcccagggtcagtg

SEQ ID NO: 290762 - DNA, 600 bp, Homo sapiens
agtgattgtacattcttctcgagggcacatgggacattctccaggatagaccatatgttaggtcaaaattcaaacttcaaaaaattcataaagtctgaatccaaactaaagatcttttccaagtacaatggaaaggacctaaaaaatcaatgagggaaaatggaaaaattcacaatgacaggtgccacagattgactactgcaaataaagccagtctgagtgcctgtgtgggccctacctccacaacttctctgaagcacagcaaatccaagaaagagtctaaaaaagagaccctgctcaccctatttctgcacctgctgttgctcacagggagactttggtacctcatggcaggttcttcaccttcaggaccaacacttgaaaatagaaggaagaggagggtcgtggacttaccagctgtggtcgctgaaggaatggtgttggttgccaaaataggtgctactgtggctgcagccactggcgtgccagtactgaagattgttttctgtgagggaaaccccacaacacagttataagaacattatccactgcgtccagggtaaacacaatcaatgccttcggtatcaccaggccctcagc

SEQ ID NO: 290763 - DNA, 667 bp, Homo sapiens
tgctcttctccgggcgctgcactgcggccgctccgcaggcagagaagccgggagcgggcgaggcggcggcggcagcagcgatggcaggaatagagttggagcggtgccagcagcaggcgaacgaggtgacggaaattatgcgtaacaacttcggcaaggtcctggagcgtggtgtgaagctggccgaactgcagcagcgttcagaccaactcctggatatgagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgccccacggacccaggatgcaggcattgcctcagggcctgggaactgacccagctggtcctgaaggagaagccaaatggctgcactggccgattctggtctccagaggaccttggtgtttgctctcccttgacccaccccagtgagtgccaaagggcagccccaacatgtgcacccctgcatttcctgtcatgccacagactggcccttgagggcagcctgctgtactggccatgctgggccagccccacctggagctcagtaaaaactgctgtttgattaaaa

SEQ ID NO: 290764 - DNA, 784 bp, Homo sapiens
tgctcttctccgggcgctgcactgcggccgctccgcaggcagagaagccgggagcgggcgaggcggcggcggcagcagcgatggcaggaatagagttggagcggtgccagcagcaggcgaacgaggtgacggaaattatgcgtaacaacttcggcaaggtcctggagcgtggtgtgaagctggccgaactgcagcagcgttcagaccaactcctggatatgagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgccccacggacccaggatgcaggcattgcctcagggcctgggaactgacccagctggtcctgaaggagaagccaaatggctgcactggccgattctggtctccagaggaccttggtgtttgctctcccttgacccaccccagtgagtgccaaagggcagccccaacatgtgcacccctgcatttcctgtcatgccacagactggcccttgagggcagcctgctgtactggccatgctgggccagccccacctggagctcagtaaaaactgctgtttgattaaaaaaaaaacaaggaagaaaacgcgagaggggggagggggaggggaggagaagagggacacagggggggagagaggggcgcggcgcgcgggggggagagagaggggggaggggagagaga

SEQ ID NO: 290765 - DNA, 899 bp, Homo sapiens
tctaaagagaattactatatttacattaggaaaattattttaattgattctgaacaaataattaacaattaccaaatgcctactatattccaggcattgtacttagatgatttacatacattatctcatttatcctcacaacaaccctatgaaataggtatattatcatccccattttatagatgaggaaattgagtaactcactcactcaaggtcacacagctggtgagtgttggagccgggattcgaacctaggtcttacttgaaagcccgtgctctttccactatactacattgcttcccacaaagttgccaactggactctgttataaaaattaaaagcacacatcacgaaaattcttggacttgcaaagcaataagcctactaacaaaataagtgctatagtttcttttgaaataaggcattctaattatctcagtatgtctgccaaccaaataatgggaaatcagggaactaacttaatatttaatacattaactattagtaaaataaaaacactcttacatccatggcctaaatactatagatattatagatgaggaaagaggcatttcctctatacaagggtgcttgctcaatgtacaataaaggtaataacacaaatattattcaagtctgtgtttttggttggggagttcctagttttaaaaaatactcatttggtgaaataaatcatcttgagatttttctgaaaccatgctgcttacaaggatttcccatattactagaatttttttacttttctgtaaacattttctaattaagccagcatttacaaaaggtttaaaaatattaaaaatgtaactttaataactaaattaagaatgccttacataatacatctaacaattcccctcagtagtattatgaaaaaaaa

SEQ ID NO: 290766 - DNA, 662 bp, Homo sapiens
tctaaagagaattactatatttacattaggaaaattattttaattgattctgaacaattgcttcccacaaagttgccaactggactctgttataaaaattaaaagcacacatcacgaaaattcttggacttgcaaagcaataagcctactaacaaaataagtgctatagtttcttttgaaataaggcattctaattatctcagtatgtctgccaaccaaataatgggaaatcagggaactaacttaatatttaatacattaactattagtaaaataaaaacactcttacatccatggcctaaatactatagatattatagatgaggaaagaggcatttcctctatacaagggtgcttgctcaatgtacaataaaggtaataacacaaatattattcaagtctgtgtttttggttggggagttcctagttttaaaaaatactcatttggtgaaataaatcatcttgagatttttctgaaaccatgctgcttacaaggatttcccatattactagaatttttttacttttctgtaaacattttctaattaagccagcatttacaaaaggtttaaaaatattaaaaatgtaactttaataactaaattaagaatgccttacataatacatctaacaattcccctcagtagtattatgaaaaaaaa

SEQ ID NO: 290767 - DNA, 453 bp, Homo sapiens
actcgggcaggggagggattcggggaggtctcatcaatttgggcctgaggaaaattcaggtggaagacaattaaataactaaccacctccgcaaggtgcagaactcaaacccaagtctccctcccacgccctgggctccagggaagcccttgggtgtcgttgttgaaacaggacgaggcgtgaccccgggtctgcgttgtttggcgtgggttctcactatgttgcttaagctggtctagaactcaagccagtctctcacttcagcctcttgagtcgttgggattacagaagccaccatgtccaactgctgatcttgaactcctgggctcaagtgatcctcccacctcggcctcccaatgtgttgggattacaggcgtgagttgcggcgcccagctgatatgtatacttttctataggtatattacacttcaataaaaagtttgaaacagaaaa

SEQ ID NO: 290768 - DNA, 571 bp, Homo sapiens
gcgtgggcgcggcagtcgccactcaccgaggttgacgaccttgagcgccgtgaagaagcggttctgccgggccaggtcctgccagggagccttggagcagtggtacttgatgaaggggaagcagccggcgtgggttctcactatgttgcttaagctggtctagaactcaagccagtctctcacttcagcctcttgagtcgttgggattacagaagccaccatgtccaactgattttgctgtgtcacccaggctggagtgccatggcatgatcatggctcactgcagcctctacctcccaggctcaagagctcctcccagctcagcctcccaagtagctgggactacagacgcataccactatgcccagctaattttttgtattttgtattttttgtagagacatggtctcactttgttttgcaggctgatcttgaactcctgggctcaagtgatcctcccacctcggcctcccaatgtgttgggattacaggcgtgagttgcggcgcccagctgatatgtatacttttctataggtatattacacttcaataaaaagtttgaaacagaaaa

SEQ ID NO: 290769 - DNA, 352 bp, Homo sapiens
gcgtgggcgcggcagtcgccactcaccgaggttgacgaccttgagcgccgtgaagaagcggttctgccgggccaggtcctgccagggagccttggagcagtggcgtgggttctcactatgttgcttaagctggtctagaactcaagccagtctctcacttcagcctcttgagtcgttgggattacagaagccaccatgtccaactgctgatcttgaactcctgggctcaagtgatcctcccacctcggcctcccaatgtgttgggattacaggcgtgagttgcggcgcccagctgatatgtatacttttctataggtatattacacttcaataaaaagtttgaaacagaaaa

SEQ ID NO: 290770 - DNA, 1054 bp, Homo sapiens
gcgtgggcgcggcagtcgccactcaccgaggttgacgaccttgagcgccgtgaagaagcggttctgccgggccaggtcctgccagggagccttggagcagtggtacttgatgaaggggaagcagccggcgtgggttctcactatgttgcttaagctggtctagaactcaagccagtctctcacttcagcctcttgagtcgttgggattacagaagccaccatgtccaactgctgatcttgaactcctgggctcaagtgatcctcccacctcggcctcccaatgtgttgggattacaggcagacaagatcttgttgcccaggctggtctcaaactcctgcgttcaaatgatactctcgccttggcctccaaaagtgttgggattgcagacctgagctactatgcctggctgaattctatttctattggattggttgtaaagaagtgcattgtagcctgcaaaggagcagggccagtggggtggagagggcagaagtgctacagaggcccctgctctccactgccctgactgctactgtgctggatgccgtgtgaaccacagctgcatctggaggccttgggcagcacctaacaggaagccagagtaggtcctctgaaggtgtttgttcaatgaacttgtcatcctcctcaacttaaagcctttagcttttccaatttggaggcacaaataagtgagaacttggggatccactgaggtctgaggcacggtggtaccagaggagatgaaggggctttcagcatgaagctggtcccctgtcgacagcacgctgattttcccgttgggctctatcagcatgtccactgtgaggttggtgacattgtctgcaggtgggaatgcttcgatcacaccccctggtgggaaaaacatggagtaggtgaaaggacacatgcattttgtttgacttgggctcagattctgcatctgccatgtcttgaaagactttgggcaagtagcttacattctctgaacttatttttctttatccgtaatatgggcataataaagcctacctcattagattgttgtgcatcttg

SEQ ID NO: 290771 - DNA, 508 bp, Homo sapiens
gccaaaccatggctcacctttttaaagagaagccccgatatccaagcaaaagaagagttatggaagcacattcaaaaagaacttgtggatccatccggattgtccgaagaacaattaaaagagattccatacactaaaatagagtgagtgcctttcagaatcttctcaccaaagctttattagtgcttgacacaaggtgacccaatccgcatcaggcattctcattcgccacgaagttaccgccagtatcgcaggtcccagtgttcagatggggagcgatcagttctctcggaagtgaattcaaaaacagatcttgtaccaccacttccggtgacccattcttcggatgctcagggttctggggatgctacagttcatcagagaagaaatgggtctaaagatagcctgatggaagaaaaacctcagacatctacaaacaacctggctggaaaacacacagcaaaaacaataaaaactatacaagcttcccgcctcaagacagaaaatt

SEQ ID NO: 290772 - DNA, 2384 bp, Homo sapiens
agccgcaggatgcgcggggacgcgccaccgccctccgcgcccagttccgccggcgcttccccggcggctcccgggcgctgactctcccgggcttttccgcctttctcgctcccgccccgccgggcggttcggcggccggtccccggaccccgccgggagctgctcgtctcaccctcgccacggcgcggacaataaattaatgcatcgcgcttgagtggagggggcggctgggcgcctcggtggtagctttctctcctggctggagacgaccacaaccgacatgggctgtttctgcgctgttccggaagaattttactgcgaagttttgctcctggatgaatccaagttaacccttaccacccagcagcagggcatcaagaagtcaacgaaaggttccgttgtccttgaccacgtattccatcacgtaaaccttgtggagatagattattttgggctacgttactgtgacagaagccatcagacgtattggctggatcctgcaaaaacccttgctgaacacaaagaactgatcaacactggacctccatatactttgtattttggtattaaattctatgctgaagatccatgtaaacttaaagaagaaataaccagatatcagtttttcttgcaggtgaagcaagatgtccttcagggccgtctgccctgtcccgtcaacactgctgctcagctgggagcgtatgccatccagtcggagcttggagattatgacccatataaacatactgcaggatatgtatctgagtaccggtttgttcctgatcagaaggaagaacttgaagaagccatagaaaggattcataaaactctaatgggtcagattccttctgaggctgagctgaattacttgaggactgccaaatccctggagatgtatggcgttgacctccatcccgtctatggagaaaacaagtctgagtatttcttaggattaactccggttggtgttgttgtgtacaagaataaaaagcaagtggggaagtatttctggcctcggattacaaaggttcacttcaaggagactcaatttgaactcagagtactgggaaaagattgtaacgaaacctcattcttttttgaagctcggagtaaaactgcttgcaagcacctctggaagtgcagtgtggaacatcatacattttttagaatgccagaaaatgaatccaattcactgtcaagaaaactcagcaagtttggatccatacgttataagcaccgctacagtggcaggacagctttgcaaatgagccgagatctttctattcagcttccccggcctgatcagaatgtgacaagaagtcgaagcaagacttaccctaagcgaatagcacaaacacagccagctgaatcaaacaccatcagtaggataactgcaaacatggaaaatggagaaaatgaaggaacaattaaaattattgcaccttcaccagtaaaaagctttaagaaagcaaagaatgaaaatagccctgatacccaaagaagcaaatctcatgcaccgtgggaagaaaatggcccccagagtggactctacaattctcccagtgatcgcactaagtcgccaaagttcccttacacgcgtcgccgaaacccctcctgtggaagtgacaatgattctgtacagcctgtgaggaggaggaaagcccataacagtggtgaagattcagatcttaagcaaaggaggaggtcacgttcacgctgtaacaccagcagtggtagtgaatcagaaaattctaatagagaacaccggaaaaagagaaacagaatacggcaggagaatgatatggttgattcagcgcctcagtgggaagctgtattaaggagacaaaaggaaaaaaaccaagccgaccccaacagcaggcgatccagacacagatctcgttcgagaagccccgatatccaagcaaaagaagagttatggaagcacattcaaaaagaacttgtggatccatccggattgtccgaagaacaattaaaagagattccatacactaaaatagagtgagtgcctttcagaatcttctcaccaaagctttattagtgcttgacacaaggtgacccaatccgcatcaggcattctcattcgccacgaagttaccgccagtatcgcaggtcccagtgttcagatggggagcgatcagttctctcggaagtgaattcaaaaacagatcttgtaccaccacttccggtgacccattcttcggatgctcagggttctggggatgctacagttcatcagagaagaaatgggtctaaagatagcctgatggaagaaaaacctcagacatctacaaacaacctggctggaaaacacacagcaaaaacaataaaaactatacaagcttcccgcctcaagacagaaaatt

SEQ ID NO: 290773 - DNA, 410 bp, Homo sapiens
gaaagatgatactaggtcaggaaatagcatttgaaagtcattctcatctggagggatgaagccaagataaggcggaacagaggaaaagctttaagaaagcaaagaatgaaaatagccctgatacccaaagaagcaaatctcatgcaccgtgggaagaaaatggcccccagagtggactctacaattctcccagtgatcgcactaagtcgccaaagttcccttacacgcgtcgccgaaacccctcctgtggaagtgacaatgattctgtacagcctgtgaggaggagggaaagcccattaacagtgggtgaagtttcagatctttaaggcaaagggagggaggttcacgttttcacggttgtttaaccacccagcagttggttagttgatttccggaaaattttcttaatt

SEQ ID NO: 290774 - DNA, 2339 bp, Homo sapiens
agccgcaggatgcgcggggacgcgccaccgccctccgcgcccagttccgccggcgcttccccggcggctcccgggcgctgactctcccgggcttttccgcctttctcgctcccgccccgccgggcggttcggcggccggtccccggaccccgccgggagctgctcgtctcaccctcgccacggcgcggacaataaattaatgcatcgcgcttgagtggagggggcggctgggcgcctcggtggtagctttctctcctggctggagacgaccacaaccgacatgggctgtttctgcgctgttccggaagaattttactgcgaagttttgctcctggatgaatccaagttaacccttaccacccagcagcagggcatcaagaagtcaacgaaaggttccgttgtccttgaccacgtattccatcacgtaaaccttgtggagatagattattttgggctacgttactgtgacagaagccatcagacgtattggctggatcctgcaaaaacccttgctgaacacaaagaactgatcaacactggacctccatatactttgtattttggtattaaattctatgctgaagatccatgtaaacttaaagaagaaataaccagatatcagtttttcttgcaggtgaagcaagatgtccttcagggccgtctgccctgtcccgtcaacactgctgctcagctgggagcgtatgccatccagtcggagcttggagattatgacccatataaacatactgcaggatatgtatctgagtaccggtttgttcctgatcagaaggaagaacttgaagaagccatagaaaggattcataaaactctaatgggtcagattccttctgaggctgagctgaattacttgaggactgccaaatccctggagatgtatggcgttgacctccatcccgtctatggagaaaacaagtctgagtatttcttaggattaactccggttggtgttgttgtgtacaagaataaaaagcaagtggggaagtatttctggcctcggattacaaaggttcacttcaaggagactcaatttgaactcagagtactgggaaaagattgtaacgaaacctcattcttttttgaagctcggagtaaaactgcttgcaagcacctctggaagtgcagtgtggaacatcatacattttttagaatgccagaaaatgaatccaattcactgtcaagaaaactcagcaagtttggatccatacgttataagcaccgctacagtggcaggacagctttgcaaatgagccgagatctttctattcagcttccccggcctgatcagaatgtgacaagaagtcgaagcaagacttaccctaagcgaatagcacaaacacagccagctgaatcaaacaccatcagtaggataactgcaaacatggaaaatggagaaaatgaaggaacaattaaaattattgcaccttcaccagtaaaaagctttaagaaagcaaagaatgaaaatagccctgatacccaaagaagcaaatctcatgcaccgtgggaagaaaatggcccccagagtggactctacaattctcccagtgatcgcactaagtcgccaaagttcccttacacgcgtcgccgaaacccctcctgtggaagtgacaatgattctgtacagcctgtgaggaggaggaaagcccataacagtggtgaagattcagatcttaagcaaaggaggaggtcacgttcacgctgtaacaccagcagtggtagtgaatcagaaaattctaatagagaacaccggaaaaagagaaacagaatacggcaggagaatgatatggttgattcagcgcctcagtgggaagctgtattaaggagacaaaaggaaaaaaaccaagccgaccccaacagcaggcgatccagacacagatctcgttcgagaagccccgatatccaagcaaaagaagagttatggaagcacattcaaaaagaacttgtggatccatccggattgtccgaagaacaattaaaagagattccatacactaaaatagagacacaaggtgacccaatccgcatcaggcattctcattcgccacgaagttaccgccagtatcgcaggtcccagtgttcagatggggagcgatcagttctctcggaagtgaattcaaaaacagatcttgtaccaccacttccggtgacccattcttcggatgctcagggttctggggatgctacagttcatcagagaagaaatgggtctaaagatagcctgatggaagaaaaacctcagacatctacaaacaacctggctggaaaacacacagcaaaaacaataaaaactatacaagcttcccgcctcaagacagaaaatt

SEQ ID NO: 290775 - DNA, 2313 bp, Homo sapiens
agccgcaggatgcgcggggacgcgccaccgccctccgcgcccagttccgccggcgcttccccggcggctcccgggcgctgactctcccgggcttttccgcctttctcgctcccgccccgccgggcggttcggcggccggtccccggaccccgccgggagctgctcgtctcaccctcgccacggcgcggacaataaattaatgcatcgcgcttgagtggagggggcggctgggcgcctcggtggtagctttctctcctggctggagacgaccacaaccgacatgggctgtttctgcgctgttccggaagaattttactgcgaagttttgctcctggatgaatccaagttaacccttaccacccagcagcagggcatcaagaagtcaacgaaaggttccgttgtccttgaccacgtattccatcacgtaaaccttgtggagatagattattttgggctacgttactgtgacagaagccatcagacgtattggctggatcctgcaaaaacccttgctgaacacaaagaactgatcaacactggacctccatatactttgtattttggtattaaattctatgctgaagatccatgtaaacttaaagaagaaataaccagatatcagtttttcttgcaggtgaagcaagatgtccttcagggccgtctgccctgtcccgtcaacactgctgctcagctgggagcgtatgccatccagtcggagcttggagattatgacccatataaacatactgcaggatatgtatctgagtaccggtttgttcctgatcagaaggaagaacttgaagaagccatagaaaggattcataaaactctaatgggtcagattccttctgaggctgagctgaattacttgaggactgccaaatccctggagatgtatggcgttgacctccatcccgtctatggagaaaacaagtctgagtatttcttaggattaactccggttggtgttgttgtgtacaagaataaaaagcaagtggggaagtatttctggcctcggattacaaaggttcacttcaaggagactcaatttgaactcagagtactgggaaaagattgtaacgaaacctcattcttttttgaagctcggagtaaaactgcttgcaagcacctctggaagtgcagtgtggaacatcatacattttttagaatgccagaaaatgaatccaattcactgtcaagaaaactcagcaagtttggatccatacgttataagcaccgctacagtggcaggacagctttgcaaatgagccgagatctttctattcagcttccccggcctgatcagaatgtgacaagaagtcgaagcaagacttaccctaagcgaatagcacaaacacagccagctgaatcaaacaccatcagtaggataactgcaaacatggaaaatggagaaaatgaaggaacaattaaaattattgcaccttcaccagtaaaaagctttaagaaagcaaagaatgaaaatagccctgatacccaaagaagcaaatctcatgcaccgtgggaagaaaatggcccccagagtggactctacaattctcccagtgatcgcactaagtcgccaaagttcccttacacgcgtcgccgaaacccctcctgtggaagtgacaatgattctgtacagcctgtgaggaggaggaaagcccataacagtggtgaagattcagatcttaagcaaaggaggaggtcacgttcacgctgtaacaccagcagtggtagtgaatcagaaaattctaatagagaacaccggaaaaagagaaacagaatacggcaggagaatgatatggttgattcagcgcctcagtgggaagctgtattaaggagacaaaaggaaaaaaaccaagccgaccccaacagcaggcgatccagacacagatctcgttcgagaagccccgatatccaagcaaaagaagagttatggaagcacattcaaaaagaacttgtggatccatccggattgtccgaagaacaattaaaagagattccatacactaaaatagagtgagtgcctttcagaatcttctcaccaaagctttattagtgcttgtgagtaatccattctaattcttcaattgtgttccagacagtgctttaatttgtctttacattttaaccaaaactaggtgacagtagcgaaagaggaagaaaagtgtgcattaaagctacttattctacactataatcactatcatctcttattagccacctctttgtacttggtaggtacaagggggcttttcctgattaatgtcagttttaaaataaattcttttctgagattctcactgaaaaaat

SEQ ID NO: 290776 - DNA, 969 bp, Homo sapiens
gaaagatgatactaggtcaggaaatagcatttgaaagtcattctcatctggagggatgaagccaagataaggcggaacagaggaaaagctttaagaaagcaaagaatgaaaatagccctgatacccaaagaagcaaatctcatgcaccgtgggaagaaaatggcccccagagtggactctacaattctcccagtgatcgcactaagtcgccaaagttcccttacacgcgtcgccgaaacccctcctgtggaagtgacaatgattctgtacagcctgtgaggaggaggaaagcccataacagtggtgaagattcagatcttaagcaaaggaggaggtcacgttcacgctgtaacaccagcagtggtagtgaatcagaaaattctaatagagaacaccggaaaaagagaaacagaatacggcaggagaatgatatggttgattcagcgcctcagtgggaagctgtattaaggagacaaaaggaaaaaaaccaagccgaccccaacagcaggcgatccagacacagatctcgttcgagaagccccgatatccaagcaaaagaagagttatggaagcacattcaaaaagaacttgtggatccatccggattgtccgaagaacaattaaaagagattccatacactaaaatagagacacaaggtgacccaatccgcatcaggcattctcattcgccacgaagttaccgccagtatcgcaggtcccagtgttcagatggggagcgatcagttctctcggaagtgaattcaaaaacagatcttgtaccaccacttccggtgacccattcttcggatgctcagggttctggggatgctacagttcatcagagaagaaatgggtctaaagatagcctgatggaagaaaaacctcagacatctacaaacaacctggctggaaaacacacagcaaaaacaataaaaactatacaagcttcccgcctcaagacagaaaatt

SEQ ID NO: 290777 - DNA, 1386 bp, Homo sapiens
cgggcgggatcagcgagcgtcgcgatgtgatgacgtcaggccccggacaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactaggcaagttgctttggcagatgccattctcattaataaaacagacctggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggta

SEQ ID NO: 290778 - DNA, 1255 bp, Homo sapiens
ctgcaggaattggcacgagactggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactaggcaagttgctttggcagatgccattctcattaataaaacagacctggttccagaagaagatgtaaagaaattaagaacgacaattagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggta

SEQ ID NO: 290779 - DNA, 1419 bp, Homo sapiens
cgggcgggatcagcgagcgtcgcgatgtgatgacgtcaggccccggacaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttagttattcagaggctgctctgctgagaagatgaacaaatttcttgtccaaaacaatgtatttcaaacgtgccgctcgggcctttcccgtattgctcactggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaatcttataaaaaaaataaatgactatcaaaaaagagaaaaaccttacgttatgttctactagttaagttttcaaggacagtgttcactagtctaccatagaccctagaagagttacccaacacatagtagcactcaaatatttgttgaatgaattataaaaatgactacttgtactgttaattttgtgtattctagtgaattaaatctcttcggcatcatttactcccttaggtatttgactttgtgtcaaatgttttggcaaggataaaattataacagactttcttgaacaaccaaaatataatctattaaggattttccttcacttttgataaaataagaaaaaaggaaattaaaaccttgcatcctaatgtaaaatagaattatatggtgtttaatatcagtgtctctttagctattatattaaactactatagttaatacattttatcattattttgtatgttggtttttaaaaatttcataaagctataaaaagatacttggtcagataa

SEQ ID NO: 290780 - DNA, 806 bp, Homo sapiens
  misc_feature (760)..(760): n is a, c, g, or t
  misc_feature (772)..(772): n is a, c, g, or t
  misc_feature (803)..(803): n is a, c, g, or t
cgggcgggatcagcgagcgtcgcgatgtgatgacgtcaggccccggacaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactagacaagttgctttggcagaaattgggcccccccccaattttttttnccctttttcccnaaaattttttttttaaaaaaaaatttttttnaaa

SEQ ID NO: 290781 - DNA, 617 bp, Homo sapiens
cgggcgggatcagcgagcgtcgcgatgtgatgacgtcaggccccggacaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtaactaacgatcccagtcactggcgtgacctctggtgtcatgggattttgcgggctgccggtgcctcttctcctgaggcatggggcctcatgatcaagagcaaatgtcttcgaggtcggggctggtcattgcttctcgtatgggttgcctctcatcttgggagttaatgatgcccggccccctctgcgttagattcccattctcaagtgagatggaaattagcctttgaagcaaggctttgacgctaagacacgcccccctttgtctctgtgactcttaccagttatcttacttccgacgctcatctacctcactgaggagt

SEQ ID NO: 290782 - DNA, 222 bp, Homo sapiens
atatttaaaaagccttcttagtgttttatagttgccaaaaaatacatggagtctttaccttgaagttcctgacaaattcttttattaaattttgactttcattttctctaggttctgttcctaaaacatctgtgaagtgtatttctgtagattaaattctgttttccattgaatgttatcttaatttcagaaaatttctgtgcagggttattttattaagct

SEQ ID NO: 290783 - DNA, 1748 bp, Homo sapiens
cgggcgggatcagcgagcgtcgcgatgtgatgacgtcaggccccggacaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactaggcaagttgctttggcagatgccattctcattaataaaacagacctggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacagttatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgac

SEQ ID NO: 290784 - DNA, 1484 bp, Homo sapiens
cgggcgggatcagcgagcgtcgcgatgtgatgacgtcaggccccggacaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttagttattcagaggctgctctgctgagaagatgaacaaatttcttgtccaaaacaatgtatttcaaacgtgccgctcgggcctttcccgtattgctcactggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactaggcaagttgctttggcagatgccattctcattaataaaacagacctggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggta

SEQ ID NO: 290785 - DNA, 1284 bp, Homo sapiens
cgggcgggatcagcgagcgtcgcgatgtgatgacgtcaggccccggacaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactaggcaagttgctttggcagatgccattctcattaataaaacagacctggttccagaagaagatgtaaagaaattaagaacgacaattagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggta

SEQ ID NO: 290786 - DNA, 1302 bp, Homo sapiens
cgggcgggatcagcgagcgtcgcgatgtgatgacgtcaggccccggacaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatgtcataactatcgtggattcgaccaatatggcttcacaccatttaacaagaaggagaaacctgatggccttatcatgaagctactagatccatacatggactagggacaaatcttagaaacccaacagatcacgagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggta

SEQ ID NO: 290787 - DNA, 1321 bp, Homo sapiens
cgggcgggatcagcgagcgtcgcgatgtgatgacgtcaggccccggacaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaatcttataaaaaaaataaatgactatcaaaaaagagaaaaaccttacgttatgttctactagttaagttttcaaggacagtgttcactagtctaccatagaccctagaagagttacccaacacatagtagcactcaaatatttgttgaatgaattataaaaatgactacttgtactgttaattttgtgtattctagtgaattaaatctcttcggcatcatttactcccttaggtatttgactttgtgtcaaatgttttggcaaggataaaattataacagactttcttgaacaaccaaaatataatctattaaggattttccttcacttttgataaaataagaaaaaaggaaattaaaaccttgcatcctaatgtaaaatagaattatatggtgtttaatatcagtgtctctttagctattatattaaactactatagttaatacattttatcattattttgtatgttggtttttaaaaatttcataaagctataaaaagatacttggtcagataa

SEQ ID NO: 290788 - DNA, 1057 bp, Homo sapiens
cgggcgggatcagcgagcgtcgcgatgtgatgacgtcaggccccggacaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtaagaagtgagattattaataaccagaatatagttctgtgatatattgtaaatagatgtattagaggaatatctaaaatgaggattaaagcttttgttagtattaaaccaaaaactttttttggtttaaaagaggaaaagtactcggttgtcattttctttggcagttgaatgaatgaacagagtatttcttggtacttttaagctgttaatagaatttgaagttttattgattgacttaggattatttgtaagaacagaagttgttaaaaataaggacatgtaggaagagcagagacgttctacctctaagtacagttgtcccttggcatccatggggtattagttccggaatctctgaggataccaaaatctattaatgttcaagtcccttacataaaatggtgtagtatttgcctataagctatgcacatcctcccatatactttaaatcatctgtagattacttataatacctaatacaatg

SEQ ID NO: 290789 - DNA, 395 bp, Homo sapiens
attttctcagcttaagagtttgtattttttaagtgaatatcagtaattaatccattaacattgatgctctatttctgcttttaagtttgaactgaggctgattaatgttcagtcaattctcctttgagcagggattggtgtcaatcaaagacaaatcacaacaagtgattgtccagggtgtccatgagctctatgatctggaggagactccagtgagctggaaggatgacactgagagaacaaatcgattggtcctccttggtaagtctcaaaggattcacagttttaaaacaaagtgaaaaatatatttgaaagggatatcatgtgccacttaaacagattaaccattcaggtcctcttttaaaactaaataagcttgtggtcaatgtttcatc

SEQ ID NO: 290790 - DNA, 622 bp, Homo sapiens
atgtgatttattgtttgaaggaaaatcacaattattttttaaagcaagttttgtttttctgtttttaatttttttctggttccagatgtatttgggtatgcttatttcctgttttagaaacaatatactttgtatacttttttaaaaagttaatttttacttttaaactttgtcttcctcatttattatttatttcagatccataaatggactaggacaaatcttagaaacacaaagatcaaggtactttaaaaaagctattcctattaataacaaatcattttagttattaataataaacattaaataattgacaaatatgcttgattctaatataagaaagatctaagtgcatttaaaaagaattggatccaaaatgttgtttggaatgctcttaataagttagtttggcatatttggctagtacatttgcctgtcttcaaaactaagaatacaaagccatgataacactgtgtaagtgtttgcttaatgaggaagaaaagacttccaaacactcgagagggtaactcagtacagaaatctgaagtatattgaggaatcttaatttgaagtgtttaaatggctttttaatatttaaaaagccttcttagtgttttatagt

SEQ ID NO: 290791 - DNA, 398 bp, Homo sapiens
cagaagaggctgtaccggccacttacagcttcccgcacgttattctggatgctcctgggatcccacagcaagcccaggtgcagccccagccgcctcccctgtgcagcacgtcctggagtcacgggcagggccctcacccacagtggggtcgccatcggtgagcaggatgatgagtgagacactcccttcgggcagccgctcctcctggttgctgctgtccagcaactgcacagccatcagcattgcatcattgatgttggtccctgaggaacacgcactctcaagtatttcagatggtttatactaaaaagttcagacatcataaacctgacaaccatcaaaagagggaagacttcaaaaacatggagtaaaagggaagtataataacaatggcagaa

SEQ ID NO: 290792 - DNA, 2115 bp, Homo sapiens
  misc_feature (1529)..(1529): n is a, c, g, or t
gggggtcgctgtgcctgtccccgtgtgatccgaaaagtgctggcaaaatgcggctgctgcttcgcccgggggggacgtggggtgccctggtgaaattttctatcctggccaactcaaatgaggatggcaagagagtgagcccttggagagagaggctgagcatcatgaagagaagaccctgggagttccctggggaccctgagtctggagctggggcaaggccccccagggcccgtcagtggcctgaggagatggttggatcattccaaacattgtctcagtgtggaaactgaggcagacagtggtcaggcaggaccatatgagaactggatgttggagccagctctagccacaggagaggagctgccggaactgaccttgctgaccacactgttggagggccctggagataagacgcagccacctgaagaggagactttgtcccaagcccctgagagtgaggaggaacagaagaagaaggctctggaaaggagtatgtatgtcctgagtgaactggtagaaacagagaaaatgtacgtggacgacttggggcagattgtggagggttatatggccaccatggctgctcagggggtccccgagagtcttcgaggccgtgacaggattgtgtttgggaatatccagcaaatctatgagtggcaccgagactatttcttgcaagagctacaacggtgtctgaaagatcctgattggctggctcagctattcatcaaacacgagcgccggctgcatatgtatgtggtgtactgtcagaataagcccaagtcagagcatgtggtgtcagagtttggggacagctactttgaggagctccggcagcagctggggcaccgcctgcagctgaacgacctcctcatcaaacctgtgcagcggatcatgaaataccagctgctgctcaaggattttctcaagtattacaatagagctgggatggatactgcagacctagagcaagctgtggaggtcatgtgctttgtgcccaagcgctgcaacgatatgatgacgctggggagattgcggggatttgagggcaaactgactgctcaggggaagctcttgggccaggacactttctgggtcaccgagcctgaggctggagggctgctgtcttcccgaggtcgagagaggcgcgtcttcctctttgagcaaatcatcatcttcagtgaagccctgggaggaggagtgagaggtggaacacagcctggatatgtatacaagaacagcattaaggtgagctgcctgggactggaggggaacctccaaggtgacccttgccgctttgcactgacctccagagggccagagggtgggatccagcgctatgtcctgcaggctgcagaccctgctatcagtcaggcctggatcaagcatgtggctcagatcttggagagccaacgggacttcctcaacgcattgcagtcacccattgagtaccagagacgggagagccagaccaacagcctggggcggccaagagggcctggagtggggagccctggaagaattcngcttggagatcaggcccagggcagcacacacacacccatcaatggctctctcccctctctgctgctgtcacccaaaggggaggtggccagagccctcttgccactggataaacaggcccttggtgacatcccccaggctccccatgactctcctccagtctctccaactccaaaaacccctccctgccaagccagacttgccaagctggatgaagatgagctgtaactggtgaaaaccatgggggtggtgctgactcagccgcctattccccaaggagcttcagggcagtccttctggcactgctccagaattcctccttcttggtgtgtctggagggtgggcaaggctgggagggatatcaacttggaggagaacacctagacccaaggacttttttctgcccaaggaacacagtttccttcagctcccatccctatgcatgcatcatggtccccccaaaaggaggatatgtgggtgggtgggagggctggggcaggggccagatagaaattattggttttgttttttaattttgtttttcctgttttctgagaataaaggttttgttatatcaccaaaaaaaaa

SEQ ID NO: 290793 - DNA, 2085 bp, Homo sapiens
  misc_feature (1499)..(1499): n is a, c, g, or t
gggggtcgctgtgcctgtccccgtgtgatccgaaaagtgctggcaaaatgcggctgctgcttcgcccgggggggacgtgaatcctattccattgcgggcagtgaggggagtatatcggcttctgctgcctccggtctggctgccccctctggccccagctctggcctcagctctggcccctgttccccaggccccccagggcccgtcagtggcctgaggagatggttggatcattccaaacattgtctcagtgtggaaactgaggcagacagtggtcaggcaggaccatatgagaactggatgttggagccagctctagccacaggagaggagctgccggaactgaccttgctgaccacactgttggagggccctggagataagacgcagccacctgaagaggagactttgtcccaagcccctgagagtgaggaggaacagaagaagaaggctctggaaaggagtatgtatgtcctgagtgaactggtagaaacagagaaaatgtacgtggacgacttggggcagattgtggagggttatatggccaccatggctgctcagggggtccccgagagtcttcgaggccgtgacaggattgtgtttgggaatatccagcaaatctatgagtggcaccgagactatttcttgcaagagctacaacggtgtctgaaagatcctgattggctggctcagctattcatcaaacacgagcgccggctgcatatgtatgtggtgtactgtcagaataagcccaagtcagagcatgtggtgtcagagtttggggacagctactttgaggagctccggcagcagctggggcaccgcctgcagctgaacgacctcctcatcaaacctgtgcagcggatcatgaaataccagctgctgctcaaggattttctcaagtattacaatagagctgggatggatactgcagacctagagcaagctgtggaggtcatgtgctttgtgcccaagcgctgcaacgatatgatgacgctggggagattgcggggatttgagggcaaactgactgctcaggggaagctcttgggccaggacactttctgggtcaccgagcctgaggctggagggctgctgtcttcccgaggtcgagagaggcgcgtcttcctctttgagcaaatcatcatcttcagtgaagccctgggaggaggagtgagaggtggaacacagcctggatatgtatacaagaacagcattaaggtgagctgcctgggactggaggggaacctccaaggtgacccttgccgctttgcactgacctccagagggccagagggtgggatccagcgctatgtcctgcaggctgcagaccctgctatcagtcaggcctggatcaagcatgtggctcagatcttggagagccaacgggacttcctcaacgcattgcagtcacccattgagtaccagagacgggagagccagaccaacagcctggggcggccaagagggcctggagtggggagccctggaagaattcngcttggagatcaggcccagggcagcacacacacacccatcaatggctctctcccctctctgctgctgtcacccaaaggggaggtggccagagccctcttgccactggataaacaggcccttggtgacatcccccaggctccccatgactctcctccagtctctccaactccaaaaacccctccctgccaagccagacttgccaagctggatgaagatgagctgtaactggtgaaaaccatgggggtggtgctgactcagccgcctattccccaaggagcttcagggcagtccttctggcactgctccagaattcctccttcttggtgtgtctggagggtgggcaaggctgggagggatatcaacttggaggagaacacctagacccaaggacttttttctgcccaaggaacacagtttccttcagctcccatccctatgcatgcatcatggtccccccaaaaggaggatatgtgggtgggtgggagggctggggcaggggccagatagaaattattggttttgttttttaattttgtttttcctgttttctgagaataaaggttttgttatatcaccaaaaaaaaa

SEQ ID NO: 290794 - DNA, 2168 bp, Homo sapiens
  misc_feature (1582)..(1582): n is a, c, g, or t
gggggtcgctgtgcctgtccccgtgtgatccgaaaagtgctggcaaaatgcggctgctgcttcgcccgggggggacgtgaatcctattccattgcgggcagtgaggggagtatatcggcttctgctgcctccggtctggctgccccctctggccccagctctggcctcagctctggcccctgttccccaggccccccagggcccgtcagtggcctgaggagatggttggatcattccaaacattgtctcagtgtggaaactgaggcagacagtggtcaggcaggaccatatgagaactggatgttggagccagctctagccacaggagaggagctgccggaactgaccttgctgaccacactgttggagggccctggagataagacgcagccacctgaagaggagactttgtcccaagcccctgagagtgaggaggaacagaagaagaaggctctggaaaggagtatgtatgtcctgagtgaactggtagaaacagagaaaatgtacgtggacgacttggggcagattgtggagggttatatggccaccatggctgctcagggggtccccgagagtcttcgaggccgtgacaggattgtgtttgggaatatccagcaaatctatgagtggcaccgagactatttcttgcaagagctacaacggtgtctgaaagatcctgattggctggctcagctattcatcaaacacgagcgccggctgcatatgtatgtggtgtactgtcagaataagcccaagtcagagcatgtggtgtcagagtttggggacagctactttgaggtcagtagctgagatgtcttggtgggaaggaggacagaactggggctttccaggctgcataaccaccctgtccctgtccccaggagctccggcagcagctggggcaccgcctgcagctgaacgacctcctcatcaaacctgtgcagcggatcatgaaataccagctgctgctcaaggattttctcaagtattacaatagagctgggatggatactgcagacctagagcaagctgtggaggtcatgtgctttgtgcccaagcgctgcaacgatatgatgacgctggggagattgcggggatttgagggcaaactgactgctcaggggaagctcttgggccaggacactttctgggtcaccgagcctgaggctggagggctgctgtcttcccgaggtcgagagaggcgcgtcttcctctttgagcaaatcatcatcttcagtgaagccctgggaggaggagtgagaggtggaacacagcctggatatgtatacaagaacagcattaaggtgagctgcctgggactggaggggaacctccaaggtgacccttgccgctttgcactgacctccagagggccagagggtgggatccagcgctatgtcctgcaggctgcagaccctgctatcagtcaggcctggatcaagcatgtggctcagatcttggagagccaacgggacttcctcaacgcattgcagtcacccattgagtaccagagacgggagagccagaccaacagcctggggcggccaagagggcctggagtggggagccctggaagaattcngcttggagatcaggcccagggcagcacacacacacccatcaatggctctctcccctctctgctgctgtcacccaaaggggaggtggccagagccctcttgccactggataaacaggcccttggtgacatcccccaggctccccatgactctcctccagtctctccaactccaaaaacccctccctgccaagccagacttgccaagctggatgaagatgagctgtaactggtgaaaaccatgggggtggtgctgactcagccgcctattccccaaggagcttcagggcagtccttctggcactgctccagaattcctccttcttggtgtgtctggagggtgggcaaggctgggagggatatcaacttggaggagaacacctagacccaaggacttttttctgcccaaggaacacagtttccttcagctcccatccctatgcatgcatcatggtccccccaaaaggaggatatgtgggtgggtgggagggctggggcaggggccagatagaaattattggttttgttttttaattttgtttttcctgttttctgagaataaaggttttgttatatcaccaaaaaaaaa

SEQ ID NO: 290795 - DNA, 2494 bp, Homo sapiens
  misc_feature (1908)..(1908): n is a, c, g, or t
gggggtcgctgtgcctgtccccgtgtgatccgaaaagtgctggcaaaatgcggctgctgcttcgcccgggggggacgtgaatcctattccattgcgggcagtgaggggagtatatcggcttctgctgcctccggtctggctgccccctctggccccagctctggcctcagctctggcccctgttccccaggccccccagggcccgtcagtggcctgaggagatggttggatcattccaaacattgtctcagtgtggaaactgaggcagacagtggtcaggcaggaccatatgagaactggatgttggagccagctctagccacaggagaggagctgccggaactgaccttgctgaccacactgttggagggccctggagataagacgcagccacctgaagaggagactttgtcccaagcccctgagagtgaggaggaacagaagaagaaggctctggaaaggagtatgtatgtcctgagtgaactggtagaaacagagaaaatgtacgtggacgacttggggcagattgtggagggttatatggccaccatggctgctcagggggtccccgagagtcttcgaggccgtgacaggattgtgtttgggaatatccagcaaatctatgagtggcaccgagagtgagtggtggaactctgacagctaggtgctggagaggggccctcatctggttgtcctgtatcctaacatcagcccattgcgacttaaggaatgtttggagaagttttgtagggcacactaccagggcagacagctcgaaactgctgggagtgggcgaggtgggggttgtgaaatgtatttgacctgctgcttctctaccaacccctccagctatttcttgcaagagctacaacggtgtctgaaagatcctgattggctggctcagctattcatcaaacacgtgaggcttgagggggcagggcctggggcggggcttaggaatgggctgggattctctggagatgcgtcctccctccttgcccaccctgctctctcttaaacattacccctgttaggagcgccggctgcatatgtatgtggtgtactgtcagaataagcccaagtcagagcatgtggtgtcagagtttggggacagctactttgaggtcagtagctgagatgtcttggtgggaaggaggacagaactggggctttccaggctgcataaccaccctgtccctgtccccaggagctccggcagcagctggggcaccgcctgcagctgaacgacctcctcatcaaacctgtgcagcggatcatgaaataccagctgctgctcaaggattttctcaagtattacaatagagctgggatggatactgcagacctagagcaagctgtggaggtcatgtgctttgtgcccaagcgctgcaacgatatgatgacgctggggagattgcggggatttgagggcaaactgactgctcaggggaagctcttgggccaggacactttctgggtcaccgagcctgaggctggagggctgctgtcttcccgaggtcgagagaggcgcgtcttcctctttgagcaaatcatcatcttcagtgaagccctgggaggaggagtgagaggtggaacacagcctggatatgtatacaagaacagcattaaggtgagctgcctgggactggaggggaacctccaaggtgacccttgccgctttgcactgacctccagagggccagagggtgggatccagcgctatgtcctgcaggctgcagaccctgctatcagtcaggcctggatcaagcatgtggctcagatcttggagagccaacgggacttcctcaacgcattgcagtcacccattgagtaccagagacgggagagccagaccaacagcctggggcggccaagagggcctggagtggggagccctggaagaattcngcttggagatcaggcccagggcagcacacacacacccatcaatggctctctcccctctctgctgctgtcacccaaaggggaggtggccagagccctcttgccactggataaacaggcccttggtgacatcccccaggctccccatgactctcctccagtctctccaactccaaaaacccctccctgccaagccagacttgccaagctggatgaagatgagctgtaactggtgaaaaccatgggggtggtgctgactcagccgcctattccccaaggagcttcagggcagtccttctggcactgctccagaattcctccttcttggtgtgtctggagggtgggcaaggctgggagggatatcaacttggaggagaacacctagacccaaggacttttttctgcccaaggaacacagtttccttcagctcccatccctatgcatgcatcatggtccccccaaaaggaggatatgtgggtgggtgggagggctggggcaggggccagatagaaattattggttttgttttttaattttgtttttcctgttttctgagaataaaggttttgttatatcaccaaaaaaaaa

SEQ ID NO: 290796 - DNA, 2209 bp, Homo sapiens
  misc_feature (1623)..(1623): n is a, c, g, or t
gggggtcgctgtgcctgtccccgtgtgatccgaaaagtgctggcaaaatgcggctgctgcttcgcccgggggggacgtgaatcctattccattgcgggcagtgaggggagtatatcggcttctgctgcctccggtctggctgccccctctggccccagctctggcctcagctctggcccctgttccccaggccccccagggcccgtcagtggcctgaggagatggttggatcattccaaacattgtctcagtgtggaaactgaggcagacagtggtcaggcaggaccatatgagaactggatgttggagccagctctagccacaggagaggagctgccggaactgaccttgctgaccacactgttggagggccctggagataagacgcagccacctgaagaggagactttgtcccaagcccctgagagtgaggaggaacagaagaagaaggctctggaaaggagtatgtatgtcctgagtgaactggtagaaacagagaaaatgtacgtggacgacttggggcagattgtggagggttatatggccaccatggctgctcagggggtccccgagagtcttcgaggccgtgacaggattgtgtttgggaatatccagcaaatctatgagtggcaccgagactatttcttgcaagagctacaacggtgtctgaaagatcctgattggctggctcagctattcatcaaacacgagcgccggctgcatatgtatgtggtgtactgtcagaataagcccaagtcagagcatgtggtgtcagagtttggggacagctactttgaggagctccggcagcagctggggcaccgcctgcagctgaacgacctcctcatcaaacctgtgcagcggatcatgaaataccagctgctgctcaaggattttctcaagtattacaatagagctgggatggatactgcagacctagagcaagctgtggaggtcatgtgctttgtgcccaagcgctgcaacgatatgatgacgctggggagattgcggggatttgagggcaaactgactgctcaggggaagctcttgggccaggacactttctgggtcaccgagcctgaggctggagggctgctgtcttcccgaggtcgagagaggcgcgtcttcctctttgagcaaatcatcatcttcagtgaagccctgggaggaggagtgagaggtggaacacagcctggatatgtatacaagaacagcattaaggtggggagaaggccacgagggagggcttggagagagagagggcatgaggcctctgagaggatgtctcagaggagccagggagggcctgaggaatctgggggctgtctcctatctgccaattcaggtgagctgcctgggactggaggggaacctccaaggtgacccttgccgctttgcactgacctccagagggccagagggtgggatccagcgctatgtcctgcaggctgcagaccctgctatcagtcaggcctggatcaagcatgtggctcagatcttggagagccaacgggacttcctcaacgcattgcagtcacccattgagtaccagagacgggagagccagaccaacagcctggggcggccaagagggcctggagtggggagccctggaagaattcngcttggagatcaggcccagggcagcacacacacacccatcaatggctctctcccctctctgctgctgtcacccaaaggggaggtggccagagccctcttgccactggataaacaggcccttggtgacatcccccaggctccccatgactctcctccagtctctccaactccaaaaacccctccctgccaagccagacttgccaagctggatgaagatgagctgtaactggtgaaaaccatgggggtggtgctgactcagccgcctattccccaaggagcttcagggcagtccttctggcactgctccagaattcctccttcttggtgtgtctggagggtgggcaaggctgggagggatatcaacttggaggagaacacctagacccaaggacttttttctgcccaaggaacacagtttccttcagctcccatccctatgcatgcatcatggtccccccaaaaggaggatatgtgggtgggtgggagggctggggcaggggccagatagaaattattggttttgttttttaattttgtttttcctgttttctgagaataaaggttttgttatatcaccaaaaaaaaa

SEQ ID NO: 290797 - DNA, 1487 bp, Homo sapiens
  misc_feature (901)..(901): n is a, c, g, or t
aaacaggggaggttgtgtgtgggggtggttatatggccaccatggctgctcagggggtccccgagagtcttcgaggccgtgacaggattgtgtttgggaatatccagcaaatctatgagtggcaccgagactatttcttgcaagagctacaacggtgtctgaaagatcctgattggctggctcagctattcatcaaacacgagctccggcagcagctggggcaccgcctgcagctgaacgacctcctcatcaaacctgtgcagcggatcatgaaataccagctgctgctcaaggattttctcaagtattacaatagagctgggatggatactgcagacctagagcaagctgtggaggtcatgtgctttgtgcccaagcgctgcaacgatatgatgacgctggggagattgcggggatttgagggcaaactgactgctcaggggaagctcttgggccaggacactttctgggtcaccgagcctgaggctggagggctgctgtcttcccgaggtcgagagaggcgcgtcttcctctttgagcaaatcatcatcttcagtgaagccctgggaggaggagtgagaggtggaacacagcctggatatgtatacaagaacagcattaaggtgagctgcctgggactggaggggaacctccaaggtgacccttgccgctttgcactgacctccagagggccagagggtgggatccagcgctatgtcctgcaggctgcagaccctgctatcagtcaggcctggatcaagcatgtggctcagatcttggagagccaacgggacttcctcaacgcattgcagtcacccattgagtaccagagacgggagagccagaccaacagcctggggcggccaagagggcctggagtggggagccctggaagaattcngcttggagatcaggcccagggcagcacacacacacccatcaatggctctctcccctctctgctgctgtcacccaaaggggaggtggccagagccctcttgccactggataaacaggcccttggtgacatcccccaggctccccatgactctcctccagtctctccaactccaaaaacccctccctgccaagccagacttgccaagctggatgaagatgagctgtaactggtgaaaaccatgggggtggtgctgactcagccgcctattccccaaggagcttcagggcagtccttctggcactgctccagaattcctccttcttggtgtgtctggagggtgggcaaggctgggagggatatcaacttggaggagaacacctagacccaaggacttttttctgcccaaggaacacagtttccttcagctcccatccctatgcatgcatcatggtccccccaaaaggaggatatgtgggtgggtgggagggctggggcaggggccagatagaaattattggttttgttttttaattttgtttttcctgttttctgagaataaaggttttgttatatcaccaaaaaaaaa

SEQ ID NO: 290798 - DNA, 1235 bp, Homo sapiens
  misc_feature (649)..(649): n is a, c, g, or t
aatcagctcggtacctctacgtgaacgcagctgctgctcaggattttctcaagtattacaatagagctgggatggatactgcagacctagagcaagctgtggaggtcatgtgctttgtgcccaagcgctgcaacgatatgatgacgctggggagattgcggggatttgagggcaaactgactgctcaggggaagctcttgggccaggacactttctgggtcaccgagcctgaggctggagggctgctgtcttcccgaggtcgagagaggcgcgtcttcctctttgagcaaatcatcatcttcagtgaagccctgggaggaggagtgagaggtggaacacagcctggatatgtatacaagaacagcattaaggtgagctgcctgggactggaggggaacctccaaggtgacccttgccgctttgcactgacctccagagggccagagggtgggatccagcgctatgtcctgcaggctgcagaccctgctatcagtcaggcctggatcaagcatgtggctcagatcttggagagccaacgggacttcctcaacgcattgcagtcacccattgagtaccagagacgggagagccagaccaacagcctggggcggccaagagggcctggagtggggagccctggaagaattcngcttggagatcaggcccagggcagcacacacacacccatcaatggctctctcccctctctgctgctgtcacccaaaggggaggtggccagagccctcttgccactggataaacaggcccttggtgacatcccccaggctccccatgactctcctccagtctctccaactccaaaaacccctccctgccaagccagacttgccaagctggatgaagatgagctgtaactggtgaaaaccatgggggtggtgctgactcagccgcctattccccaaggagcttcagggcagtccttctggcactgctccagaattcctccttcttggtgtgtctggagggtgggcaaggctgggagggatatcaacttggaggagaacacctagacccaaggacttttttctgcccaaggaacacagtttccttcagctcccatccctatgcatgcatcatggtccccccaaaaggaggatatgtgggtgggtgggagggctggggcaggggccagatagaaattattggttttgttttttaattttgtttttcctgttttctgagaataaaggttttgttatatcaccaaaaaaaaa

SEQ ID NO: 290799 - DNA, 1220 bp, Homo sapiens
gggggtcgctgtgcctgtccccgtgtgatccgaaaagtgctggcaaaatgcggctgctgcttcgcccgggggggacgtgaatcctattccattgcgggcagtgaggggagtatatcggcttctgctgcctccggtctggctgccccctctggccccagctctggcctcagctctggcccctgttccccaggccccccagggcccgtcagtggcctgaggagatggttggatcattccaaacattgtctcagtgtggaaactgaggcagacagtggtcaggcaggaccatatgagaactggatgttggagccagctctagccacaggagaggagctgccggaactgaccttgctgaccacactgttggagggccctggagataagacgcagccacctgaagaggagactttgtcccaagcccctgagagtgaggaggaacagaagaagaaggctctggaaaggagtatgtatgtcctgagtgaactggtagaaacagagaaaatgtacgtggacgacttggggcagattgtggagggttatatggccaccatggctgctcagggggtccccgagagtcttcgaggccgtgacaggattgtgtttgggaatatccagcaaatctatgagtggcaccgagactatttcttgcaagagctacaacggtgtctgaaagatcctgattggctggctcagctattcatcaaacacgagcgccggctgcatatgtatgtggtgtactgtcagaataagcccttggtgacatcccccaggctccccatgactctcctccagtctctccaactccaaaaacccctccctgccaagccagacttgccaagctggatgaagatgagctgtaactggtgaaaaccatgggggtggtgctgactcagccgcctattccccaaggagcttcagggcagtccttctggcactgctccagaattcctccttcttggtgtgtctggagggtgggcaaggctgggagggatatcaacttggaggagaacacctagacccaaggacttttttctgcccaaggaacacagtttccttcagctcccatccctatgcatgcatcatggtccccccaaaaggaggatatgtgggtgggtgggagggctggggcaggggccagatagaaattattggttttgttttttaattttgtttttcctgttttctgagaataaaggttttgttatatcaccaaaaaaaaa

SEQ ID NO: 290800 - DNA, 1572 bp, Homo sapiens
gggggtcgctgtgcctgtccccgtgtgatccgaaaagtgctggcaaaatgcggctgctgcttcgcccgggggggacgtgaatcctattccattgcgggcagtgaggggagtatatcggcttctgctgcctccggtctggctgccccctctggccccagctctggcctcagctctggcccctgttccccaggccccccagggcccgtcagtggcctgaggagatggttggatcattccaaacattgtctcagtgtggaaactgaggcagacagtggtcaggcaggaccatatgagaactggatgttggagccagctctagccacaggagaggagctgccggaactgaccttgctgaccacactgttggagggccctggagataagacgcagccacctgaagaggagactttgtcccaagcccctgagagtgaggaggaacagaagaagaaggctctggaaaggagtatgtatgtcctgagtgaactggtagaaacagagaaaatgtacgtggacgacttggggcagattgtggagggttatatggccaccatggctgctcagggggtccccgagagtcttcgaggccgtgacaggattgtgtttgggaatatccagcaaatctatgagtggcaccgagactatttcttgcaagagctacaacggtgtctgaaagatcctgattggctggctcagctattcatcaaacacgagcgccggctgcatatgtatgtggtgtactgtcagaataagcccaagtcagagcatgtggtgtcagagtttggggacagctactttgaggagctccggcagcagctggggcaccgcctgcagctgaacgacctcctcatcaaacctgtgcagcggatcatgaaataccagctgctgctcaaggattttctcaagtattacaatagagctgggatggatactgcagacctagagcaagctgtggaggtcatgtgctttgtgcccaagcgctgcaacgatatgatgacgctggggagattgcggggatttgagggcaaactgactgctcaggggaagctcttgggccaggacactttctgggtcaccgagcctgaggctggagggctgctgtcttcccgaggtcgagagaggcgcgtcttcctctttgagcaaatcatcatcttcagtgaagccctgggaggaggagtgagaggtggaacacagctggatgaagatgagctgtaactggtgaaaaccatgggggtggtgctgactcagccgcctattccccaaggagcttcagggcagtccttctggcactgctccagaattcctccttcttggtgtgtctggagggtgggcaaggctgggagggatatcaacttggaggagaacacctagacccaaggacttttttctgcccaaggaacacagtttccttcagctcccatccctatgcatgcatcatggtccccccaaaaggaggatatgtgggtgggtgggagggctggggcaggggccagatagaaattattggttttgttttttaattttgtttttcctgttttctgagaataaaggttttgttatatcaccaaaaaaaaa

SEQ ID NO: 290801 - DNA, 1046 bp, Homo sapiens
gggggtcgctgtgcctgtccccgtgtgatccgaaaagtgctggcaaaatgcggctgctgcttcgcccgggggggacgtgaatcctattccattgcgggcagtgaggggagtatatcggcttctgctgcctccggtctggctgccccctctggccccagctctggcctcagctctggcccctgttccccaggccccccagggcccgtcagtggcctgaggagatggttggatcattccaaacattgtctcagtgtggaaactgaggcagacagtggtcaggcaggaccatatgagaactggatgttggagccagctctagccacaggagaggagctgccggaactgaccttgctgaccacactgttggagggccctggagataagacgcagccacctgaagaggagactttgtcccaagcccctgagagtgaggaggaacagaagaagaaggctctggaaaggagtatgtatgtcctgagtgaactggtagaaacagagaaaatgtacgtggacgacttggggcagattgtggagggttatatggccaccatggctgctcagggggtccccgagagtcttcgaggccgtgacaggattgtgtttgggaatatccagcaaatctatgagtggcaccgagactatttcttgcaagagctacaacggtgtctgaaagatcctgattggctggctcagctattcatcaaacacgagcgccggctgcatatgtatgtggtgtactgtcagaataagcccaagtcagagcatgtggtgtcagagtttggggacagctactttgaggagctccggcagcagctggggcaccgcctgcagctgaacgacctcctcatcaaacctgtgcagcggatcatgaaataccagctgctgctcaaggattttctcaagtattacaatagagctgggatggatactgcagacctagagcaagctgtggaggtcatgtgctttgtgcccaagcgctgcaacgatatgatgacgctggggagattgcggggatttgaggggaaaagacctgggtaccgagctcc

SEQ ID NO: 290802 - DNA, 427 bp, Homo sapiens
acgacctcctcatcaaacctgtgcagcggatcatgaaataccagctgctgctcaaggtcaggaccccctttttcctgggggcacagctggctggcacagctgtttcctcattcatctccccagggttcttagggctcccccagacttcctgagggccctcactggtgtcctcaggggaggatgtgagagcttctaagggtgtcctcgtgacctccctgagcatttcttctctctgtcttaggattttctcaagtattacaatagagctgggatggatactgcagacctagaggtgaggaccccagatcttccaggacacaccatgtgctccttatcctcctagtatctcatgggttcccccagccccttgggtggtttacagctgtctggtttttagggggaggctggttggggttgagataccgtc

SEQ ID NO: 290803 - DNA, 714 bp, Homo sapiens
ggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttcta

SEQ ID NO: 290804 - DNA, 499 bp, Homo sapiens
  misc_feature (26)..(26): n is a, c, g, or t
  misc_feature (38)..(38): n is a, c, g, or t
cggagcggatggcatgacccgtccanacgctcgaagcnggacccgtactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttcta

SEQ ID NO: 290805 - DNA, 318 bp, Homo sapiens
cgtcgacatcctggccattgagtccctccatagcagcctgggcaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttcta

SEQ ID NO: 290806 - DNA, 441 bp, Homo sapiens
acatattagaagtattatttttctttttccccctctagatttctagttccttttcagtattggattggatttgagatttgattaacctagtactcaggttcagatgctcgcctctttgcaattttaacactcattcgacaataaagtcagtaaaaaacacaaatttggttatgtcactctctttttactttagtgtctctccactgcactcagaataaagtacaattttattatttgtgatctggcttgctcttcccctctcagttcattactcaccattttctagtcctcagctttagtagcattgagatcctctatcctccatcctccctagcatttctcctattttaattggtctaacacctatctctgaagaatcaaattttaacatctggaaagcttttcctgactgcacggctgtgtcagacacccctatccact

SEQ ID NO: 290807 - DNA, 2789 bp, Homo sapiens
ggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgcta

SEQ ID NO: 290808 - DNA, 3148 bp, Homo sapiens
ggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgctattgggctgcccctccccctttttgttaaattgctgggttttccaactgaatcagtaaaaactatttctgtttagagctacaaggttaaagtgcctgctttccagtaatggagattgagtcactattaatttgataaaaggtaagctcagtaggcatcagattcctagatacaaggcatttgggaaagtgattttagcagacatgagggacatttaggaaagatgaatagtttcagcctaagagaattttgtgaactgtttggagttacgatcaggctactctgagctagttgggaaatggtctttcctcttcccatctcttgcattcatatatttctaagttttttttttttttttgtt

SEQ ID NO: 290809 - DNA, 2694 bp, Homo sapiens
ggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtaagaatgttaaataataaaatttaacattttccaaatgcta

SEQ ID NO: 290810 - DNA, 2735 bp, Homo sapiens
ggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacatgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgcta

SEQ ID NO: 290811 - DNA, 2635 bp, Homo sapiens
cccagcaaagatgccccagacaggaaggtgatcccagtgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgcta

SEQ ID NO: 290812 - DNA, 2825 bp, Homo sapiens
cccagcaaagatgccccagacaggaaggtgatcccagtgacagcgtggagcaggatggcgatgaacccggaccacaacgctgtgagtaataatggaacctgtgaggtatccgtgtctgtggtagtagttagaaaccaataaaatagttaaacgcagtaggaatgggttcagagatagcttaaacaatctgagtccgcactcactctattcctgtgagcctgcttaaagtgtctctcatgtactcatacaacttccccccgtcccccaacagctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgcta

SEQ ID NO: 290813 - DNA, 2631 bp, Homo sapiens
ggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttcttacccccagggattatgatagaaatatgaagccaccaagtctagacttgatggtgttcaagaataaataatatccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgctattgggctgcccctccccctttttgttaaattgctgggttttccaactgaatcagtaaaaactatttctgtttagagctacaaggttaaagtgcctgctttccagtaatggagattgagtcactattaatttgataaaaggtaagctcagtaggcatcagattcctagatacaaggcatttgggaaagtgattttagcagacatgagggacatttaggaaagatgaatagtttcagcctaagagaattttgtgaactgtttggagttacgatcaggctactctgagctagttgggaaatggtctttcctcttcccatctcttgcattcatatatttctaagttttttttttttttttgtt

SEQ ID NO: 290814 - DNA, 3093 bp, Homo sapiens
ggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggtatcctaagtgacactttattgcctcctttctttcataagccttaggtagcattcgtagttctgtgtttgctgtggttggccaagagcaaagttgaaataaaatgacattggaaatctatgttttgtcagacacgccaaagagacagaaacggagatgatgtatatatacagtagagatatatgatgtacattcattgtttaaagtgtgtagatttttctgagtttagatttgaggaaaaagatactcagtgatacttggggaaataggagggttttcatatctgtcttttcactttccccaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgcta

SEQ ID NO: 290815 - DNA, 1642 bp, Homo sapiens
ggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcttgagccaccaggcctttctttgttcttaggagtatagtcagactaacttctagtagttatatttctaataattgaggatgtaagtaaggatcaaatcttaaatcagtataatgcattgtcattccagagataaatcctagacccttcttggcctccttctgacataattctaatcctacagtctcagagatgctgttgtatcctgccccccaaccccatgatagtgatagtggtttttgccttgaaggaattgctttgtatttagcttttccccctctagatttctagttccttttcagtattggattggatttgagatttgattaacctagtactcaggttcagatgctcgcctctttgcaattttaacactcattcgacaataaagtcagtaaaaaacacaaatttggttatgtcactctctttttactttagtgtctctccactgcactcagaataaagtacaattttattatttgtgatctggcttgctcttcccctctcagttcattactcaccattttctagtcctcagctttagtagcattgagatcctctatcctccatcctccctagcatttctcctattttaattggtctaacacctatctctgaagaatcaaattttaacatctggaaagcttttcctgactgcacggctgtgtcagacacccctatccact

SEQ ID NO: 290816 - DNA, 2309 bp, Homo sapiens
  misc_feature (17)..(17): n is a, c, g, or t
tgttttggtccgggggncccaccaaaaagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgcta

SEQ ID NO: 290817 - DNA, 790 bp, Homo sapiens
  misc_feature (790)..(790): n is a, c, g, or t
ggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctaaaaaaaaaaatcggactcgctggccctaacggaggagctcttgcgaccagtttctcttaaagaggcaccccatgan

SEQ ID NO: 290818 - DNA, 787 bp, Homo sapiens
  misc_feature (759)..(759): n is a, c, g, or t
  misc_feature (775)..(775): n is a, c, g, or t
  misc_feature (781)..(781): n is a, c, g, or t
ggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctaaaaaaaaaaaaaaaaaaaaaaaaaaaaaaaaaaaaaaaaaaaaanacacaagcaacaaacnaacaangacaca

SEQ ID NO: 290819 - DNA, 750 bp, Homo sapiens
cccagcaaagatgccccagacaggaaggtgatcccagtgacagcgtggagcaggatggcgatgaacccggaccacaacgctgtgagtaataatggaacctgtgaggtatccgtgtctgtggtagtagttagaaaccaataaaatagttaaacgcagtaggaatgggttcagagatagcttaaacaatctgagtccgcactcactctattcctgtgagcctgcttaaagtgtctctcatgtactcatacaacttccccccgtcccccaacagctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttcta

SEQ ID NO: 290820 - DNA, 725 bp, Homo sapiens
  misc_feature (696)..(696): n is a, c, g, or t
ggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagacaagcaaacttacccggttgcaaagaggctttcttgcagaagggtcagaatggcggcagtggagcatcgtcattcttcaggattgccctagtggccctacctcacagctgaaactttaaaaaacaggatgggccaacagacacctcctccaactcaaaaaattctataattgataactccctgagnctaaagaacacttccgagtgtgtgctcta

SEQ ID NO: 290821 - DNA, 823 bp, Homo sapiens
  misc_feature (795)..(795): n is a, c, g, or t
  misc_feature (811)..(811): n is a, c, g, or t
  misc_feature (817)..(817): n is a, c, g, or t
cccagcaaagatgccccagacaggaaggtgatcccagtgacagcgtggagcaggatggcgatgaacccggaccacaacgctgtgagtaataatggaacctgtgaggtatccgtgtctgtggtagtagttagaaaccaataaaatagttaaacgcagtaggaatgggttcagagatagcttaaacaatctgagtccgcactcactctattcctgtgagcctgcttaaagtgtctctcatgtactcatacaacttccccccgtcccccaacagctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctaaaaaaaaaaaaaaaaaaaaaaaaaaaaaaaaaaaaaaaaaaaaanacacaagcaacaaacnaacaangacaca

SEQ ID NO: 290822 - DNA, 1018 bp, Homo sapiens
ggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggtatcctaagtgacactttattgcctcctttctttcataagccttaggtagcattcgtagttctgtgtttgctgtggttggccaagagcaaagttgaaataaaatgacattggaaatctatgttttgtcagacacgccaaagagacagaaacggagatgatgtatatatacagtagagatatatgatgtacattcattgtttaaagtgtgtagatttttctgagtttagatttgaggaaaaagatactcagtgatacttggggaaataggagggttttcatatctgtcttttcactttccccaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttcta

SEQ ID NO: 290823 - DNA, 788 bp, Homo sapiens
  misc_feature (215)..(215): n is a, c, g, or t
  misc_feature (391)..(391): n is a, c, g, or t
  misc_feature (396)..(396): n is a, c, g, or t
ctgtattcaaaaagttttttaaattagcttgttatcccttcatgtgataattaatctcaaatactttttcgatacctcagagcattattttcataatgactgtgttcacaatctttttaggttaactcgttttctctttgtgattaaggagaaacactttgatattctgatagagtggccttcattttagtatttttcaagaccacttttcaacnactcactttaggataagttttaggtaaaatgtgcatcattatcctgaattatttcagttaagcatgttagttggtggcataagagaaaactcaatcagatagtgctgaagacaggactgtggagacaccttagaaggacagattctgttccgaatcaccgatgcggcgtcagcagnactgncctagcggaggctctgggagggtggctgccaggcccggcctgggctttgggtctccccggactacccagagctgggatgcgtggcttctgctgccgggccgactggctgctcaggccccagcccttgttaatggacttggaggaatgattccatgccaaagctttgcaaggctcgcagtgaccaggcgcccgacatggttggctgcagaaggtccgaagaaagaggagttactggaggaaaaagtggttcagaggtgactattcaaccgcataagagatggtgaaaattaacctatcaccactgctaatgaacatcaccctatggagaaccgagacacaaaagggaagattcagaatgtgtgacttgtataaaataaaaccagtttcccccg

SEQ ID NO: 290824 - DNA, 2778 bp, Homo sapiens
  misc_feature (7)..(8): n is a, c, g, or t
tcattannagtaagtcaccagaacagtccacactcaaggggaggggattcttaagggcatgagtaccaggaagtgggagtcactgggatcatcttagaggctgcctaccagactcagtttacagctttcccaggtatcatccccttaaagatctcgactaatttctcatcaccttccctcctaaagacacaaaaaatccaagttcactgatcctggaatggggaacctcacctacagcaacccctcctaccgaacatccacacaggaagtgaagattgaagcaatccccaaaccagccatgtacaaccagctgtgctataagaaagagggagggcctgaccataactacaccaaggagaagatcaagatcgtagagggaatctgcctcctgtctggggatgatgctgagtgggatgacctcaagcaactgcgaagctcacgggggggcctcctccgggatcatgtatgcatgaagacagacacggtgtccatccaggccagctctggctccctggatgacacagagacggagcagctgttacaggaagagcagtctgagtgtagcagcgtccatactgcagccactccagaaagacgaggctctctgccagacacgggctggaaacatgaacgcaagctctcctcagagagccaggtctaaatgcccacattctcttccctgcctgcctgttccttctcctttatggacgtctagtccttgtgctcgcttacaccgcaggccccgcttctgtgtgcttgtcctcctcctcctcccaccccataactgttcctaagccttcaccggagctgtttaccacgtgagtccataactacctgtgcacaagaaatgatggcacatcacgagaatttagacctggattttaccatgaacctcacatcttgtactccatcctgggccccctgaaactgcttattcgtgattcctcaccagcgtagagctccacctcccctttccccagtaccctcagtgcctgcttctcagtgctgatgcagctgatgacccaggactgcgctctgccccatcacagccagcatgactgcttctctgagagaacttgcccatcaggggctgggacatgggggtgtgggtaaagacagggatgaaggatagaggctgagagaagaaggaagaatcagcccagcaggtatgggcatctgggaaacctccagcctcaagtgtgttggtaacatgaaaaagctctggggggtagttggatctgggtgtctggtccattgctggcagtggacattattcttgccctaagagacactgcctttttcagcagcagatactggtgagatgggggtggctcaggctgttcttcctcctcctagaatgtctggagctgtttctacattcagataactgggtcccctatcacaaggctactggctaataggaattccctcctggtgccaccactggccagtacctttcctaagtctttgctcaaattaaccaggttgtgagccagtggcttgagtgaatgttaggccttgggggctgagtctctgaaaagtctaagaagctctgcctagaccaaatatggtatacctcctgacccctctctccctcatgtcctgggattctggggaagagacctagaaacaagctttcaaagaaaaaccagaagttgtcataaatggtcagaaagaacgatcaggttggagacttgggaaacccagggcctaaagagaagtatccatgagggtcaaacttcctgttgaacttcctatgttctttctcaagtgctcagggatctaagttagtggacagcaagcctgtggctacggggtggtgatgttcctcttccagctgtcccctcagctaaggggcttagtttccatgtgggatgccatcacttggttcatgctcattcacacaaagggcacgtgtctcagcctggtatcagggaaattgagacttatttttgccctaaaacgtctccctagctgttcttcgtggggtttttttgtttgtttttttgcctaatttgctttttctgaccaagccttgtggcaccagcaatctccaaagtcctgtggtgggagggctgaataaataaaaatacaaagaggtgggtaaggagtaggaaggtagagagcaccactgatgaggccctcctagcccatggcagacccagacctcttctcccccaggaattagaagtggcaggagagaacaacaggggctgggaatggaggggagaatttctaggggaagtttcctgagttgaaacttctcctgtggttactggtattgagaaatcagctaccaaagtgaaaaaggacaagatcaattcttttctagtcagttctaagactgctagagagagataccaggcccttagccttgctctcagtagcgtcagccccagttctgagcctccccacattacacttaacaagcagtaaaggagtgagcactttgggtccttagactcatgtctggggaggaagagcaagtagaaaagtggcattttcttgattggaaagggggaaggatcttattgcacttgggctgttcagaatgtagaaaggacatatttgaggaagtatctatttgagcactgatttactctgtaaaaagcaaaatctctctgtcctaaactaatggaagcgattctcccatgctcatgtgtaatggttttaacgttactcactggagagattggactttctggagttatttaaccactatgttcagtattttaggactttatgataatttaatataaatttagcttttcttaatca

SEQ ID NO: 290825 - DNA, 554 bp, Homo sapiens
gcggccgctcccacttcagattggtaagcaatctccaaagtcctgtggttactggtattgagaaatcagctaccaaagtgaaaaaggacaagatcaattcttttctagtcagttctaagactgctagagagagataccaggcccttagccttgctctcagtagcgtcagccccagttctgagcctccccacattacacttaacaagcagtaaaggagtgagcactttgggtccttagactcatgtctggggaggaagagcaagtagaaaagtggcattttcttgattggaaagggggaaggatcttattgcacttgggctgttcagaatgtagaaaggacatatttgaggaagtatctatttgagcactgatttactctgtaaaaagcaaaatctctctgtcctaaactaatggaagcgattctcccatgctcatgtgtaatggttttaacgttactcactggagagattggactttctggagttatttaaccactatgttcagtattttaggactttatgataatttaatataaatttagcttttcttaatca

SEQ ID NO: 290826 - DNA, 453 bp, Homo sapiens
ccactcagctctgtggaacttctccccagtggcctaaatgctgattcctgggacagttccaaatataggttccccactcccgctttataggaaccagtttaccaagacctggaggccaccactatgtctcatgcctttctttctgcatcctgcacattctcagtaccttccagactcttgccaagatgcaggcatgtctttccctgctgctccaggggaaggacttcatatcagctacgccattggtggactcctcagtattctgctgattttggtggtgattgcagctttgatgctgtacaggtaacttcagtcttgctacaggggccacatgctcattggtcttcatgagcatgtctgggatctcccgaagctctgcagttcactgaatcaagctctgaccagccttattgcaaggttgggtgcctggtcagagcagcagggaggaaaggg

SEQ ID NO: 290827 - DNA, 648 bp, Homo sapiens
acatctatcatgctgggtgctgaggaatgtactcatagatacctggtctctatccctgtggagcttacagttcagtggggtccagttatgggaacatgggttaaagttctactctattctgggtcagtctggttgctcatccaacactgggctctccccaaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaacttggatggttctgagcggaaggtcctcatcaacacagacctgggttggcccaatggccttaccctggactatgatacccgcaggatctactgggtggatgcgcatctggaccggatcgagagtgctgacctcaatgggaaactgcggcaggtcttggtcggccatgtgtcccacccctttgccctcacacaggcaggactcaaggcagagaggta

SEQ ID NO: 290828 - DNA, 3784 bp, Homo sapiens
acctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaacttggatggttctgagcggaaggtcctcatcaacacagacctgggttggcccaatggccttaccctggactatgatacccgcaggatctactgggtggatgcgcatctggaccggatcgagagtgctgacctcaatgggaaactgcggcaggtcttggtcggccatgtgtcccacccctttgccctcacacagcaagacaggtggatctactggacagactggcagaccaagtcaatccagcgtgttgacaaatactcaggccggaacaaggagacagtgctggcaaatgtggaaggactcatggatatcatcgtggtttcccctcagcggcagacagggaccaatgcctgtggtgtgaacaatggtggctgcacccacctctgctttgccagagcctcggacttcgtatgtgcctgtcctgacgaacctgatagccagccctgctcccttgtgcctggcctggtaccaccagctcctagggctactggcatgagtgaaaagagcccagtgctacccaacacaccacctaccaccttgtattcttcaaccacccggacccgcacgtctctggaggaggtggaaggaagatgctctgaaagggatgccaggctgggcctctgtgcacgttccaatgacgctgttcctgctgctccaggggaaggacttcatatcagctacgccattggtggactcctcagtattctgctgattttggtggtgattgcagctttgatgctgtacaggtaacttcacacaaaaaatccaagttcactgatcctggaatggggaacctcacctacagcaacccctcctaccgaacatccacacaggaagtgaagattgaagcaatccccaaaccagccatgtacaaccagctgtgctataagaaagagggagggcctgaccataactacaccaaggagaagatcaagatcgtagagggaatctgcctcctgtctggggatgatgctgagtgggatgacctcaagcaactgcgaagctcacgggggggcctcctccgggatcatgtatgcatgaagacagacacggtgtccatccaggccagctctggctccctggatgacacagagacggagcagctgttacaggaagagcagtctgagtgtagcagcgtccatactgcagccactccagaaagacgaggctctctgccagacacgggctggaaacatgaacgcaagctctcctcagagagccaggtctaaatgcccacattctcttccctgcctgcctgttccttctcctttatggacgtctagtccttgtgctcgcttacaccgcaggccccgcttctgtgtgcttgtcctcctcctcctcccaccccataactgttcctaagccttcaccggagctgtttaccacgtgagtccataactacctgtgcacaagaaatgatggcacatcacgagaatttagacctggattttaccatgaacctcacatcttgtactccatcctgggccccctgaaactgcttattcgtgattcctcaccagcgtagagctccacctcccctttccccagtaccctcagtgcctgcttctcagtgctgatgcagctgatgacccaggactgcgctctgccccatcacagccagcatgactgcttctctgagagaacttgcccatcaggggctgggacatgggggtgtgggtaaagacagggatgaaggatagaggctgagagaagaaggaagaatcagcccagcaggtatgggcatctgggaaacctccagcctcaagtgtgttggtaacatgaaaaagctctggggggtagttggatctgggtgtctggtccattgctggcagtggacattattcttgccctaagagacactgcctttttcagcagcagatactggtgagatgggggtggctcaggctgttcttcctcctcctagaatgtctggagctgtttctacattcagataactgggtcccctatcacaaggctactggctaataggaattccctcctggtgccaccactggccagtacctttcctaagtctttgctcaaattaaccaggttgtgagccagtggcttgagtgaatgttaggccttgggggctgagtctctgaaaagtctaagaagctctgcctagaccaaatatggtatacctcctgacccctctctccctcatgtcctgggattctggggaagagacctagaaacaagctttcaaagaaaaaccagaagttgtcataaatggtcagaaagaacgatcaggttggagacttgggaaacccagggcctaaagagaagtatccatgagggtcaaacttcctgttgaacttcctatgttctttctcaagtgctcagggatctaagttagtggacagcaagcctgtggctacggggtggtgatgttcctcttccagctgtcccctcagctaaggggcttagtttccatgtgggatgccatcacttggttcatgctcattcacacaaagggcacgtgtctcagcctggtatcagggaaattgagacttatttttgccctaaaacgtctccctagctgttcttcgtggggtttttttgtttgtttttttgcctaatttgctttttctgaccaagccttgtggcaccagcaatctccaaagtcctgtggtgggagggctgaataaataaaaatacaaagaggtgggtaaggagtaggaaggtagagagcaccactgatgaggccctcctagcccatggcagacccagacctcttctcccccaggaattagaagtggcaggagagaacaacaggggctgggaatggaggggagaatttctaggggaagtttcctgagttgaaacttctcctgtggttactggtattgagaaatcagctaccaaagtgaaaaaggacaagatcaattcttttctagtcagttctaagactgctagagagagataccaggcccttagccttgctctcagtagcgtcagccccagttctgagcctccccacattacacttaacaagcagtaaaggagtgagcactttgggtccttagactcatgtctggggaggaagagcaagtagaaaagtggcattttcttgattggaaagggggaaggatcttattgcacttgggctgttcagaatgtagaaaggacatatttgaggaagtatctatttgagcactgatttactctgtaaaaagcaaaatctctctgtcctaaactaatggaagcgattctcccatgctcatgtgtaatggttttaacgttactcactggagagattggactttctggagttatttaaccactatgttcagtattttaggactttatgataatttaatataaatttagcttttcttaatca

SEQ ID NO: 290829 - DNA, 2215 bp, Homo sapiens
cggacgcgtgggtcgaccacgcgtcggaaagacgaggctctctgccagacacgggctggaaacatgaacgcaagctctcctcagagagccaggtctaaatgcccacattctcttccctgcctgcctgttccttctcctttatggacgtctagtccttgtgctcgcttacaccgcaggccccgcttctgtgtgcttgtcctcctcctcctcccaccccataactgttcctaagccttcaccggagctgtttaccacgtgagtccataactacctgtgcacaagaaatgatggcacatcacgagaatttagacctggattttaccatgaacctcacatcttgtactccatcctgggccccctgaaactgcttattcgtgattcctcaccagcgtagagctccacctcccctttccccagtaccctcagtgcctgcttctcagtgctgatgcagctgatgacccaggactgcgctctgccccatcacagccagcatgactgcttctctgagagaacttgcccatcaggggctgggacatgggggtgtgggtaaagacagggatgaaggatagaggctgagagaagaaggaagaatcagcccagcaggtatgggcatctgggaaacctccagcctcaagtgtgttggtaacatgaaaaagctctggggggtagttggatctgggtgtctggtccattgctggcagtggacattattcttgccctaagagacactgcctttttcagcagcagatactggtgagatgggggtggctcaggctgttcttcctcctcctagaatgtctggagctgtttctacattcagataactgggtcccctatcacaaggctactggctaataggaattccctcctggtgccaccactggccagtacctttcctaagtctttgctcaaattaaccaggttgtgagccagtggcttgagtgaatgttaggccttgggggctgagtctctgaaaagtctaagaagctctgcctagaccaaatatggtatacctcctgacccctctctccctcatgtcctgggattctggggaagagacctagaaacaagctttcaaagaaaaaccagaagttgtcataaatggtcagaaagaacgatcaggttggagacttgggaaacccagggcctaaagagaagtatccatgagggtcaaacttcctgttgaacttcctatgttctttctcaagtgctcagggatctaagttagtggacagcaagcctgtggctacggggtggtgatgttcctcttccagctgtcccctcagctaaggggcttagtttccatgtgggatgccatcacttggttcatgctcattcacacaaagggcacgtgtctcagcctggtatcagggaaattgagacttatttttgccctaaaacgtctccctagctgttcttcgtggggtttttttgtttgtttttttgcctaatttgctttttctgaccaagccttgtggcaccagcaatctccaaagtcctgtggtgggagggctgaataaataaaaatacaaagaggtgggtaaggagtaggaaggtagagagcaccactgatgaggccctcctagcccatggcagacccagacctcttctcccccaggaattagaagtggcaggagagaacaacaggggctgggaatggaggggagaatttctaggggaagtttcctgagttgaaacttctcctgtggttactggtattgagaaatcagctaccaaagtgaaaaaggacaagatcaattcttttctagtcagttctaagactgctagagagagataccaggcccttagccttgctctcagtagcgtcagccccagttctgagcctccccacattacacttaacaagcagtaaaggagtgagcactttgggtccttagactcatgtctggggaggaagagcaagtagaaaagtggcattttcttgattggaaagggggaaggatcttattgcacttgggctgttcagaatgtagaaaggacatatttgaggaagtatctatttgagcactgatttactctgtaaaaagcaaaatctctctgtcctaaactaatggaagcgattctcccatgctcatgtgtaatggttttaacgttactcactggagagattggactttctggagttatttaaccactatgttcagtattttaggactttatgataatttaatataaatttagcttttcttaatca

SEQ ID NO: 290830 - DNA, 4160 bp, Homo sapiens
acctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaacttggatggttctgagcggaaggtcctcatcaacacagacctgggttggcccaatggccttaccctggactatgatacccgcaggatctactgggtggatgcgcatctggaccggatcgagagtgctgacctcaatgggaaactgcggcaggtcttggtcggccatgtgtcccacccctttgccctcacacagcaagacaggtggatctactggacagactggcagaccaagtcaatccagcgtgttgacaaatactcaggccggaacaaggagacagtgctggcaaatgtggaaggactcatggatatcatcgtggtttcccctcagcggcagacagggaccaatgcctgtggtgtgaacaatggtggctgcacccacctctgctttgccagagcctcggacttcgtatgtgcctgtcctgacgaacctgatagccagccctgctcccttgtgcctggcctggtaccaccagctcctagggctactggcatgagtgaaaagagcccagtgctacccaacacaccacctaccaccttgtattcttcaaccacccggacccgcacgtctctggaggaggtggaaggaagatgctctgaaagggatgccaggctgggcctctgtgcacgttccaatgacgctgttcctgctgctccaggggaaggacttcatatcagctacgccattggtggactcctcagtattctgctgattttggtggtgattgcagctttgatgctgtacaggtaacttcacacaaaaaatccaagttcactgatcctggaatggggaacctcacctacagcaacccctcctaccgaacatccacacaggaagtgaagattgaagcaatccccaaaccagccatgtacaaccagctgtgctataagaaagagggagggcctgaccataactacaccaaggagaagatcaagatcgtagagggaatctgcctcctgtctggggatgatgctgagtgggatgacctcaagcaactgcgaagctcacgggggggcctcctccgggatcatgtatgcatgaagacagacacggtgtccatccaggccagctctggctccctggatgacacagagacggagcagctgttacaggaagagcagtctgagtgtagcagcgtccatactgcagccactccagaaagacgaggctctctgccagacacgggctggaaacatgaacgcaagctctcctcagagagccaggtctaaatgcccacattctcttccctgcctgcctgttccttctcctttatggacgtctagtccttgtgctcgcttacaccgcaggccccgcttctgtgtgcttgtcctcctcctcctcccaccccataactgttcctaagccttcaccggagctgtttaccacgtgagtccataactacctgtgcacaagaaatgatggcacatcacgagaatttagacctggattttaccatgaacctcacatcttgtactccatcctgggccccctgaaactgcttattcgtgattcctcaccagcgtagagctccacctcccctttccccagtaccctcagtgcctgcttctcagtgctgatgcagctgatgacccaggactgcgctctgccccatcacagccagcatgactgcttctctgagagaacttgcccatcaggggctgggacatgggggtgtgggtaaagacagggatgaaggatagaggctgagagaagaaggaagaatcagcccagcaggtatgggcatctgggaaacctccagcctcaagtgtgttggtaacatgaaaaagctctggggggtagttggatctgggtgtctggtccattgctggcagtggacattattcttgccctaagagacactgcctttttcagcagcagatactggtgagatgggggtggctcaggctgttcttcctcctcctagaatgtctggagctgtttctacattcagataactgggtcccctatcacaaggctactggctaataggaattccctcctggtgccaccactggccagtacctttcctaagtctttgctcaaattaaccaggttgtgagccagtggcttgagtgaatgttaggccttgggggctgagtctctgaaaagtctaagaagctctgcctagaccaaatatggtatacctcctgacccctctctccctcatgtcctgggattctggggaagagacctagaaacaagctttcaaagaaaaaccagaagttgtcataaatggtcagaaagaacgatcaggttggagacttgggaaacccagggcctaaagagaagtatccatgagggtcaaacttcctgttgaacttcctatgttctttctcaagtgctcagggatctaagttagtggacagcaagcctgtggctacggggtggtgatgttcctcttccagctgtcccctcagctaaggggcttagtttccatgtgggatgccatcacttggttcatgctcattcacacaaagggcacgtgtctcagcctggtatcagggaaattgagacttatttttgccctaaaacgtctccctagctgttcttcgtggggtttttttgtttgtttttttgcctaatttgctttttctgaccaagccttgtggcaccagcaatctccaaagtcctgtggtgggagggctgaataaataaaaatacaaagaggtgggtaaggagtaggaaggtagagagcaccactgatgaggccctcctagcccatggcagacccagacctcttctcccccaggaattagaagtggcaggagagaacaacaggggctgggaatggaggggagaatttctaggggaagtttcctgagttgaaacttctcctgtggttactggtattgagaaatcagctaccaaagtgaaaaaggacaagatcaattcttttctagtcagttctaagactgctagagagagataccaggcccttagccttgctctcagtagcgtcagccccagttctgagcctccccacattacacttaacaagcagtaaaggagtgagcactttgggtccttagactcatgtctggggaggaagagcaagtagaaaagtggcattttcttgattggaaagggggaaggatcttattgcacttgggctgttcagaatgtagaaaggacatatttgaggaagtatctatttgagcactgatttactctgtaaaaagcaaaatctctctgtcctaaactaatggaagcgattctcccatgctcatgtgtaatggttttaacgttactcactggagagattggactttctggagttatttaaccactatgttcagtattttaggactttatgataatttaatataaatttagcttttcttaatcaccttgcctggcttggagtcatgactaatcctgcacctgctctgtctggcagacccatgctgtggaaaacctgcttacagacatcacttttaagtcctttgtggatgtgggcacagtgaagagcaataaagagtgtgaggttcctgctggagttttcagctcatctggagaagacaggtcgaggccagagttccttgactgatgaaacctttatttcctctggaagaggaatggtagatgggtttcctcttgagtgctgactctgactggttggtagtggctgcctgagggcctattcgcacccaatgggaagaatgtcatatggctagtgacatctcttctgtgcactggaaggaaatgtcatggcatgtatacca

SEQ ID NO: 290831 - DNA, 3532 bp, Homo sapiens
acctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaacttggatggttctgagcggaaggtcctcatcaacacagacctgggttggcccaatggccttaccctggactatgatacccgcaggatctactgggtggatgcgcatctggaccggatcgagagtgctgacctcaatgggaaactgcggcaggtcttggtcggccatgtgtcccacccctttgccctcacacagcaagacaggtggatctactggacagactggcagaccaagtcaatccagcgtgttgacaaatactcaggccggaacaaggagacagtgctggcaaatgtggaaggactcatggatatcatcgtggtttcccctcagcggcagacagggaccaatgcctgtggtgtgaacaatggtggctgcacccacctctgctttgccagagcctcggacttcgtatgtgcctgtcctgacgaacctgatagccagccctgctcccttgtgcctggcctggtaccaccagctcctagggctactggcatgagtgaaaagagcccagtgctacccaacacaccacctaccaccttgtattcttcaaccacccggacccgcacgtctctggaggaggtggaaggaagatgctctgaaagggatgccaggctgggcctctgtgcacgttccaatgacgctgttcctgctgctccaggggaaggacttcatatcagctacgccattggtggactcctcagtattctgctgattttggtggtgattgcagctttgatgctgtacaggtaacttcacacaaaaaatccaagttcactgatcctggaatggggaacctcacctacagcaacccctcctaccgaacatccacacaggaagtgaagattgaagcaatccccaaaccagccatgtacaaccagctgtgctataagaaagagggagggcctgaccataactacaccaaggagaagatcaagatcgtagagggaatctgcctcctgtctggggatgatgctgagtgggatgacctcaagcaactgcgaagctcacgggggggcctcctccgggatcatgtatgcatgaagacagacacggtgtccatccaggccagctctggctccctggatgacacagagacggagcagctgttacaggaagagcagtctgagtgtagcagcgtccatactgcagccactccagaaagacgaggctctctgccagacacgggctggaaacatgaacgcaagctctcctcagagagccaggtctaaatgcccacattctcttccctgcctgcctgttccttctcctttatggacgtctagtccttgtgctcgcttacaccgcaggccccgcttctgtgtgcttgtcctcctcctcctcccaccccataactgttcctaagccttcaccggagctgtttaccacgtgagtccataactacctgtgcacaagaaatgatggcacatcacgagaatttagacctggattttaccatgaacctcacatcttgtactccatcctgggccccctgaaactgcttattcgtgattcctcaccagcgtagagctccacctcccctttccccagtaccctcagtgcctgcttctcagtgctgatgcagctgatgacccaggactgcgctctgccccatcacagccagcatgactgcttctctgagagaacttgcccatcaggggctgggacatgggggtgtgggtaaagacagggatgaaggatagaggctgagagaagaaggaagaatcagcccagcaggtatgggcatctgggaaacctccagcctcaagtgtgttggtaacatgaaaaagctctggggggtagttggatctgggtgtctggtccattgctggcagtggacattattcttgccctaagagacactgcctttttcagcagcagatactggtgagatgggggtggctcaggctgttcttcctcctcctagaatgtctggagctgtttctacattcagataactgggtcccctatcacaaggctactggctaataggaattccctcctggtgccaccactggccagtacctttcctaagtctttgctcaaattaaccaggttgtgagccagtggcttgagtgaatgttaggccttgggggctgagtctctgaaaagtctaagaagctctgcctagaccaaatatggtatacctcctgacccctctctccctcatgtcctgggattctggggaagagacctagaaacaagctttcaaagaaaaaccagaagttgtcataaatggtcagaaagaacgatcaggttggagacttgggaaacccagggcctaaagagaagtatccatgagggtcaaacttcctgttgaacttcctatgttctttctcaagtgctcagggatctaagttagtggacagcaagcctgtggctacggggtggtgatgttcctcttccagctgtcccctcagctaaggggcttagtttccatgtgggatgccatcacttggttcatgctcattcacacaaagggcacgtgtctcagcctggtatcagggaaattgagacttatttttgccctaaaacgtctccctagctgttcttcgtggggtttttttgtttgtttttttgcctaatttgctttttctgaccaagccttgtggcaccagcaatctccaaagtcctgtggtgggagggctgaataaataaaaatacaaagaggtgggtaaggagtaggaaggtagagagcaccactgatgaggccctcctagcccatggcagacccagacctcttctcccccaggaattagaagtggcaggagagaacaacaggggctgggaatggaggaagagcaagtagaaaagtggcattttcttgattggaaagggggaaggatcttattgcacttgggctgttcagaatgtagaaaggacatatttgaggaagtatctatttgagcactgatttactctgtaaaaagcaaaatctctctgtcctaaactaatggaagcgattctcccatgctcatgtgtaatggttttaacgttactcactggagagattggactttctggagttatttaaccactatgttcagtattttaggactttatgataatttaatataaatttagcttttcttaatca

SEQ ID NO: 290832 - DNA, 2311 bp, Homo sapiens
acctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaacttggatggttctgagcggaaggtcctcatcaacacagacctgggttggcccaatggccttaccctggactatgatacccgcaggatctactgggtggatgcgcatctggaccggatcgagagtgctgacctcaatgggaaactgcggcaggtcttggtcggccatgtgtcccacccctttgccctcacacagcaagacaggtggatctactggacagactggcagaccaagtcaatccagcgtgttgacaaatactcaggccggaacaaggagacagtgctggcaaatgtggaaggactcatggatatcatcgtggtttcccctcagcggcagacagggaccaatgcctgtggtgtgaacaatggtggctgcacccacctctgctttgccagagcctcggacttcgtatgtgcctgtcctgacgaacctgatagccagccctgctcccttgtgcctggcctggtaccaccagctcctagggctactggcatgagtgaaaagagcccagtgctacccaacacaccacctaccaccttgtattcttcaaccacccggacccgcacgtctctggaggaggtggaaggaagatgctctgaaagggatgccaggctgggcctctgtgcacgttccaatgacgctgttcctgctgctccaggggaaggacttcatatcagctacgccattggtggactcctcagtattctgctgattttggtggtgattgcagctttgatgctgtacaggtaacttcacacaaaaaatccaagttcactgatcctggaatggggaacctcacctacagcaacccctcctaccgaacatccacacaggaagtgaagattgaagcaatccccaaaccagccatgtacaaccagctgtgctataagaaagagggagggcctgaccataactacaccaaggagaagatcaagatcgtagagggaatctgcctcctgtctggggatgatgctgagtgggatgacctcaagcaactgcgaagctcacgggggggcctcctccgggatcatgtatgcatgaagacagacacggtgtccatccaggccagctctggctccctggatgacacagagacggagcagctgttacaggaagagcagtctgagtgtagcagcgtccatactgcagccactccagaaagacgaggctctctgccagacacgggctggaaacatgaacgcaagctctcctcagagagccaggtctaaatgcccacattctcttccctgcctgcctgttccttctcctttatggacgtctagtccttgtgctcgcttacaccgcaggccccgcttctgtgtgcttgtcctcctcctcctcccaccccataactgttcctaagccttcaccggagctgtttaccacgtgagtccataactacctgtgcacaagaaatgatggcacatcacgagaatttagacctggattttaccatgaacctcacatcttgtactccatcctgggccccctgaaactgcttattcgtgattcctcaccagcgtagagctccacctcccctttccccagtaccctcagtgcctgcttctcagtgctgatgcagctgatgacccaggactgcgctctgccccatcacagccagcatgactgcttctctgagagaacttgcccatcaggggctgggacatgggggtgtgggtaaagacagggatgaaggatagaggctgagagaagaaggaagaatcagcccagcaggtatgggcatctgggaaacctccagcctcaagtgtgttggtaacatgaaaaagctctggggggtagttggatctggatggacttagcattcccccaccttgaccatattttcattcccccggatacttggacctttccc

SEQ ID NO: 290833 - DNA, 456 bp, Homo sapiens
ctagaggatcccggtcaatttctacacagagagagataccaggcccttagccttgctctcagtagcgtcagccccagttctgagcctccccacattacacttaacaagcagtaaaggagtgagcactttgggtccttagactcatgtctggggaggaagagcaagtagaaaagtggcattttcttgattggaaagggggaaggatcttattgcacttgggctgttcagaatgtagaaaggacatatttgaggaagtatctatttgagcactgatttactctgtaaaaagcaaaatctctctgtcctaaactaatggaagcgattctcccatgctcatgtgtaatggttttaacgttactcactggagagattggactttctggagttatttaaccactatgttcagtattttaggactttatgataatttaatataaatttagcttttcttaatca

SEQ ID NO: 290834 - DNA, 1945 bp, Homo sapiens
acctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaacttggatggttctgagcggaaggtcctcatcaacacagacctgggttggcccaatggccttaccctggactatgatacccgcaggatctactgggtggatgcgcatctggaccggatcgagagtgctgacctcaatgggaaactgcggcaggtcttggtcggccatgtgtcccacccctttgccctcacacagcaagacaggtggatctactggacagactggcagaccaagtcaatccagcgtgttgacaaatactcaggccggaacaaggagacagtgctggcaaatgtggaaggactcatggatatcatcgtggtttcccctcagcggcagacagggaccaatgcctgtggtgtgaacaatggtggctgcacccacctctgctttgccagagcctcggacttcgtatgtgcctgtcctgacgaacctgatagccagccctgctcccttgtgcctggcctggtaccaccagctcctagggctactggcatgagtgaaaagagcccagtgctacccaacacaccacctaccaccttgtattcttcaaccacccggacccgcacgtctctggaggaggtggaaggaagatgctctgaaagggatgccaggctgggcctctgtgcacgttccaatgacgctgttcctgctgctccaggggaaggacttcatatcagctacgccattggtggactcctcagtattctgctgattttggtggtgattgcagctttgatgctgtacaggtaacttcacacaaaaaatccaagttcactgatcctggaatggggaacctcacctacagcaacccctcctaccgaacatccacacaggaagtgaagattgaagcaatccccaaaccagccatgtacaaccagctgtgctataagaaagagggagggcctgaccataactacaccaaggagaagatcaagatcgtagagggaatctgcctcctgtctggggatgatgctgagtgggatgacctcaagcaactgcgaagctcacgggggggcctcctccgggatcatgtatgcatgaagacagacacggtgtccatccaggccagctctggctccctggatgacacagagacggagcagctgttacaggaagagcagtctgagtgtagcagcgtccatactgcagccactccagaaagacgaggcttctgtctggcagacccatgctgtggaaaacctgcttacagacatcacttttaagtcctttgtggatgtgggcacagtgaagagcaataaagagtgtgaggttcctgctggagttttcagctcatctggagaagacaggtcgaggccagagttccttgactgatgaaacctttatttcctctggaagaggaatggtagatgggtttcctcttgagtgctgactctgactggttggtagtggctgcctgagggcctattcgcacccaatgggaagaatgtcatatggctagtgacatctcttctgtgcactggaaggaaatgtcatggcatgtatacca

SEQ ID NO: 290835 - DNA, 1224 bp, Homo sapiens
acctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaacttggatggttctgagcggaaggtcctcatcaacacagacctgggttggcccaatggccttaccctggactatgatacccgcaggatctactgggtggatgcgcatctggaccggatcgagagtgctgacctcaatgggaaactgcggcaggtcttggtcggccatgtgtcccacccctttgccctcacacagcaagacaggtggatctactggacagactggcagaccaagtcaatccagcgtgttgacaaatactcaggccggaacaaggagacagtgctggcaaatgtggaaggactcatggatatcatcgtggtttcccctcagcggcagacagggaccaatgcctgtggtgtgaacaatggtggctgcacccacctctgctttgccagagcctcggacttcgtatgtgcctgtcctgacgaacctgatagccagccctgctcccttgtgcctggcctggtaccaccagctcctagggctactggcatgagtgaaaagagcccagtgctacccaacacaccacctaccaccttgtattcttcaaccacccggacccgcacgtctctggaggaggtggaaggaagatgctctgaaagggatgccaggctgggcctctgtgcacgttccaatgacgctgttcctgctgctccaggggaaggacttcatatcagctacgccattggtggactcctcagtattctgctgattttggtggtgattgcagctttgatgctgtacaggtaacttcgtgaagtcttgctggtggaaggaccgagctga

SEQ ID NO: 290836 - DNA, 737 bp, Homo sapiens
acctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtaagtttatggccagcagaagagagatccagggaagaagggctgggtggaaagatggtgttagtgggtcctctgtgttctctcaacctctgggtgctgtcttcccatgccttgatgatgatggcactgttgtgtctcaggtacctcttctggacagactggggccacattgccaagatcgaacgggcaaacttggatggttctgagcggaaggtcctcatcaacacagacctgggttggcccaatggccttaccctggactatgatacccgcaggtgggagtcttgcatcaaacagcctccgagtttttttgtttttgatatgccatgcgacgcacccccatcgccc

SEQ ID NO: 290837 - DNA, 2248 bp, Homo sapiens
  misc_feature (1056)..(1056): n is a, c, g, or t
  misc_feature (1178)..(1178): n is a, c, g, or t
  misc_feature (1206)..(1206): n is a, c, g, or t
ctgggatcaggcaaccctctcacctcagcctcccaagtagctgggactacaggtgcacgctaccatgcctggctaatttttttgtacttttagtaaagacggggttttgtcatgttgctcgggctagcctcaaactcctgggctcaagcgatcctccctcctcggcctcccaaagtgctgggattacaggcttgagccaccgcacctggccttccccatttttctcttaatccatatctcagacaggaatctgtatctctcactctacagatcattctgtaggcactatgctaaactgacaccagtttcaaatttagtccttaattgatcttggcctttaggtgagcaaagttacagtggtaaattacgctccttcgcttacaaaatctcttgcttggtatttattccccaggggttacatagaatagagtggaggcagtagacatggagaaatcctatcttttaagaaagaaaaaaatgggcatttttctcatggggaaggatttttatttttcaaataggtgtttgaactgtaatgatttcatgacatctgcctaacggttttgtttctttgtcttacagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcacngtgaaggggctgaagcacccccaccgctatgtgctggacgccgcacaaacccacatttacatgctcatgaagaaggattcttatgctcgctatttaaaatctccgatctataaggacatgcnggccaaagctattgaacctcaggaaacnaccaagaaaagctccaccctcccttttatgcggcgtcacctgcgctccagcccaagccctgtcatcctgagacagctggaagaggaagccaaggcccgagaagcagccaacactgtggacatcacccagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaactttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataaaaggttaactttaagtttcttgga

SEQ ID NO: 290838 - DNA, 2399 bp, Homo sapiens
  misc_feature (1207)..(1207): n is a, c, g, or t
  misc_feature (1329)..(1329): n is a, c, g, or t
  misc_feature (1357)..(1357): n is a, c, g, or t
aggctgcctttcgaacttggggggcttctcctcttgtctcccactggtgctctggctgtgaatccatccaggggccaggatgacaatccgacaccaaggccagcagtacaggccgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaaggtaaaccagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcacngtgaaggggctgaagcacccccaccgctatgtgctggacgccgcacaaacccacatttacatgctcatgaagaaggattcttatgctcgctatttaaaatctccgatctataaggacatgcnggccaaagctattgaacctcaggaaacnaccaagaaaagctccaccctcccttttatgcggcgtcacctgcgctccagcccaagccctgtcatcctgagacagctggaagaggaagccaaggcccgagaagcagccaacactgtggacatcacccagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaactttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataaaaggttaactttaagtttcttgga

SEQ ID NO: 290839 - DNA, 457 bp, Homo sapiens
cattactggctttcctcttgcacctgaagctttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataaaaggttaactttaagtttcttgga

SEQ ID NO: 290840 - DNA, 280 bp, Homo sapiens
atggcgtctgaagccagaggccccacggaggccgttctgccgcttacttaaaattgagagagcagtctgaaggcacttcagcagatcctcagatgctccgtccgcacgatcgacacttgacacagagcttactgctgcctcttgcagacccaaagggcctatagaggcttctctaggccttccttaaccatcacccgctgcagcagaccacgtgtggtttctgttaacatccagatttcctagttcccatctagacttattgagttgtcactcctgggga

SEQ ID NO: 290841 - DNA, 364 bp, Homo sapiens
cccgagatgcaggcagaggtgagcttgggatagaagttggcaataaacatgatgctccttgctcattcttggagtgacaaagtgtctgttggtccaacagagacattttcttcccagtcctgtgacctttcccagacccaaagggcctatagaggcttctctaggccttccttaaccatcacccgctgcagcagaccacgtgtggtttctgttaacatccagatttcctagttcccatctagacttattgagttgtcactcctggggataagacctgggaggtcctccttttagcgtgcaacccagctcacgcttgtccacagccaagttcagcaaccagtgtcctcactgctcatgagatgca

SEQ ID NO: 290842 - DNA, 388 bp, Homo sapiens
atccagatttcctagttcccatctagacttattgagttgtcactcctggggataagacctgggaggtcctccttttagcgtgcaacccagctcacgcttgtccacagccaagttcagcaaccagtgtcctcactgctcatgagatgcagtgctgttaggaaggggcacctgtcctggagtttggggtgccgtgggggccggcaatgagctcctgtctcagccctgctcttaacatccatgtctgaactgcttttcccagaggcacagaacttgggcaactttattgtcaggtatggctacatttaccccctgcaagaccccaagaatctcattctcaagcctgatggcagcctctacagatttcaggtgagtcttggccttgaccctg

SEQ ID NO: 290843 - DNA, 550 bp, Homo sapiens
cgatctgtaaaatggggatcacacctcactgggttttctaagaattaaaggacttgaaacatgtgaagcacttacaatagggcctagcacacagtaaatactcaatatatgttaggaattactgttactactcctactacttatactgagagatgaattttaaaagataccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaacaaaataaacacctaatgagccactta

SEQ ID NO: 290844 - DNA, 4411 bp, Homo sapiens
actctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgtctgttctgtccgctgccacaagttcctagtatccagggttggtgaagattggatcttcctggtcctgctggggcttctcatggcattggtcagctgggtcatggactatgccattgctgcctgtctgcaagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagttctggatgtctgcactggccaccaccatcccagttccctgtggggccttcatgcctgtctttgtcattggagcagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctagccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaacaaaataaacacctaatgagccacttatatatagaatgcttgtgcccgttggctctcgttcttaccttgggccctcttacctgccaaagcctacaaggcccttaattctaaagccacccacccttcccacaaccataaaaacgtacagtccagtgaccttggaatgcaggatctgccagaggcctccactacgtgggcattaacaccctggctggggtggggccctgtactgtagccttggcctttcattcagacagaaaggctctaccttctttcctccccaagaagagacactccctcatgactgtcactcactggcacaattcctgcctctcagcaggcatcagctgacaactcccggccacccctgtggccctcttgtggccctctctagaagaacatgaagtcccagctctgtggcaaccagagccatcctttcttccacctcccgctcagagagctctgcgtgaatgggcagcccggctggctgtgaggcgccagcacactgcccgcacatcctaggaggggttgggaaagggcccaggccccattagggggccaggaaaagggtggagggtacatgctttcatcattccaaagcctcccagagaagagaagatccgactgaaaaaacagaccaaaaaccttctgtctttaggaaaaaagaggaagatttagagacgatggagaggtgaatgaagcacagcacgagcccagctgggcaggggcccttgagggacggctcaacccataggctccgggagggcaggagccagcccctccaggtgggggtgattctatcaagcactgcacatggactcggaagtgagaagaaaagcagagaagagagaggcatggggagggtggggggttgctgggcccctcccaccccaccctcacacagcccagtaacaacccccttagtggttcacattatccgaggaggaaatgtgtgtgtggcattttaagaacatgaacatcactgtctgccacagctgtagccatgccccagaggccccgggcaacccccggcaagccccgggagtgggggcaggacatgcgcccccagcccagcccctgcctcctctccaaacactttcatgcaaaacacacaacggagaagcgagcgctcccaggagccctctaggctgtggagctctgctgggagccttgagcccacacttgggcacagaggctctgcccct

SEQ ID NO: 290845 - DNA, 3233 bp, Homo sapiens
actctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgtctgttctgtccgctgccacaagttcctagtatccagggttggtgaagattggatcttcctggtcctgctggggcttctcatggcattggtcagctgggtcatggactatgccattgctgcctgtctgcaagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagttctggatgtctgcactggccaccaccatcccagttccctgtggggccttcatgcctgtctttgtcattggagcagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctagccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaacaaaataaacacctaatgagccactta

SEQ ID NO: 290846 - DNA, 3404 bp, Homo sapiens
  misc_feature (3247)..(3247): n is a, c, g, or t
  misc_feature (3272)..(3273): n is a, c, g, or t
actctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgtctgttctgtccgctgccacaagttcctagtatccagggttggtgaagattggatcttcctggtcctgctggggcttctcatggcattggtcagctgggtcatggactatgccattgctgcctgtctgcaagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagttctggatgtctgcactggccaccaccatcccagttccctgtggggccttcatgcctgtctttgtcattggagcagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctagccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaacaaaataaacacctaatgagccacttaaaaaaaaaaaaaanataaaaaaaaaaaaaaaaaaaaaannaaaaaaaaaaaaaaaaaaaaatcaatgcccggcggtttacaactttgtgattgggaaaacctggcgtacccaactatgcttggagcacattccccttcgcccgttggcttaccggctcgaccgtttccttt

SEQ ID NO: 290847 - DNA, 4341 bp, Homo sapiens
actctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgtctgttctgtccgctgccacaagttcctagtatccagggttggtgaagattggatcttcctggtcctgctggggcttctcatggcattggtcagctgggtcatggactatgccattgctgcctgtctgcaagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaaggagcagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctagccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaacaaaataaacacctaatgagccacttatatatagaatgcttgtgcccgttggctctcgttcttaccttgggccctcttacctgccaaagcctacaaggcccttaattctaaagccacccacccttcccacaaccataaaaacgtacagtccagtgaccttggaatgcaggatctgccagaggcctccactacgtgggcattaacaccctggctggggtggggccctgtactgtagccttggcctttcattcagacagaaaggctctaccttctttcctccccaagaagagacactccctcatgactgtcactcactggcacaattcctgcctctcagcaggcatcagctgacaactcccggccacccctgtggccctcttgtggccctctctagaagaacatgaagtcccagctctgtggcaaccagagccatcctttcttccacctcccgctcagagagctctgcgtgaatgggcagcccggctggctgtgaggcgccagcacactgcccgcacatcctaggaggggttgggaaagggcccaggccccattagggggccaggaaaagggtggagggtacatgctttcatcattccaaagcctcccagagaagagaagatccgactgaaaaaacagaccaaaaaccttctgtctttaggaaaaaagaggaagatttagagacgatggagaggtgaatgaagcacagcacgagcccagctgggcaggggcccttgagggacggctcaacccataggctccgggagggcaggagccagcccctccaggtgggggtgattctatcaagcactgcacatggactcggaagtgagaagaaaagcagagaagagagaggcatggggagggtggggggttgctgggcccctcccaccccaccctcacacagcccagtaacaacccccttagtggttcacattatccgaggaggaaatgtgtgtgtggcattttaagaacatgaacatcactgtctgccacagctgtagccatgccccagaggccccgggcaacccccggcaagccccgggagtgggggcaggacatgcgcccccagcccagcccctgcctcctctccaaacactttcatgcaaaacacacaacggagaagcgagcgctcccaggagccctctaggctgtggagctctgctgggagccttgagcccacacttgggcacagaggctctgcccct

SEQ ID NO: 290848 - DNA, 4477 bp, Homo sapiens
actctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgtctgttctgtccgctgccacaagttcctagtatccagggttggtgaagattggatcttcctggtcctgctggggcttctcatggcattggtcagctgggtcatggactatgccattgctgcctgtctgcaagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaccctgagatatgcgaggccacccagcccttggccacccacgactgatgtgaaacctacgactctagacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagttctggatgtctgcactggccaccaccatcccagttccctgtggggccttcatgcctgtctttgtcattggagcagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctagccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaacaaaataaacacctaatgagccacttatatatagaatgcttgtgcccgttggctctcgttcttaccttgggccctcttacctgccaaagcctacaaggcccttaattctaaagccacccacccttcccacaaccataaaaacgtacagtccagtgaccttggaatgcaggatctgccagaggcctccactacgtgggcattaacaccctggctggggtggggccctgtactgtagccttggcctttcattcagacagaaaggctctaccttctttcctccccaagaagagacactccctcatgactgtcactcactggcacaattcctgcctctcagcaggcatcagctgacaactcccggccacccctgtggccctcttgtggccctctctagaagaacatgaagtcccagctctgtggcaaccagagccatcctttcttccacctcccgctcagagagctctgcgtgaatgggcagcccggctggctgtgaggcgccagcacactgcccgcacatcctaggaggggttgggaaagggcccaggccccattagggggccaggaaaagggtggagggtacatgctttcatcattccaaagcctcccagagaagagaagatccgactgaaaaaacagaccaaaaaccttctgtctttaggaaaaaagaggaagatttagagacgatggagaggtgaatgaagcacagcacgagcccagctgggcaggggcccttgagggacggctcaacccataggctccgggagggcaggagccagcccctccaggtgggggtgattctatcaagcactgcacatggactcggaagtgagaagaaaagcagagaagagagaggcatggggagggtggggggttgctgggcccctcccaccccaccctcacacagcccagtaacaacccccttagtggttcacattatccgaggaggaaatgtgtgtgtggcattttaagaacatgaacatcactgtctgccacagctgtagccatgccccagaggccccgggcaacccccggcaagccccgggagtgggggcaggacatgcgcccccagcccagcccctgcctcctctccaaacactttcatgcaaaacacacaacggagaagcgagcgctcccaggagccctctaggctgtggagctctgctgggagccttgagcccacacttgggcacagaggctctgcccct

SEQ ID NO: 290849 - DNA, 4213 bp, Homo sapiens
gaggactgggaataaacctcctgcgtccatgccacactcgtctagacatggaggaaggcgtcttggcttcttggccactgaccactttccccagccagtctgactgcccagattcaggcatcatctcggccactcccacagggcacagcttcttgcatcccctctccaagtgatcctcttgcctagattgcgctttgtcccagtgaataccctcagggaccctttccttcacccatgccctgactctgtgtggtactccctgggacagcctgtcgtatcagcgtggtccactggccaggcaggcagtgggtgtgtgcactgggggtccagcaggtcctcttcccacagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaaggagcagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctagccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaacaaaataaacacctaatgagccacttatatatagaatgcttgtgcccgttggctctcgttcttaccttgggccctcttacctgccaaagcctacaaggcccttaattctaaagccacccacccttcccacaaccataaaaacgtacagtccagtgaccttggaatgcaggatctgccagaggcctccactacgtgggcattaacaccctggctggggtggggccctgtactgtagccttggcctttcattcagacagaaaggctctaccttctttcctccccaagaagagacactccctcatgactgtcactcactggcacaattcctgcctctcagcaggcatcagctgacaactcccggccacccctgtggccctcttgtggccctctctagaagaacatgaagtcccagctctgtggcaaccagagccatcctttcttccacctcccgctcagagagctctgcgtgaatgggcagcccggctggctgtgaggcgccagcacactgcccgcacatcctaggaggggttgggaaagggcccaggccccattagggggccaggaaaagggtggagggtacatgctttcatcattccaaagcctcccagagaagagaagatccgactgaaaaaacagaccaaaaaccttctgtctttaggaaaaaagaggaagatttagagacgatggagaggtgaatgaagcacagcacgagcccagctgggcaggggcccttgagggacggctcaacccataggctccgggagggcaggagccagcccctccaggtgggggtgattctatcaagcactgcacatggactcggaagtgagaagaaaagcagagaagagagaggcatggggagggtggggggttgctgggcccctcccaccccaccctcacacagcccagtaacaacccccttagtggttcacattatccgaggaggaaatgtgtgtgtggcattttaagaacatgaacatcactgtctgccacagctgtagccatgccccagaggccccgggcaacccccggcaagccccgggagtgggggcaggacatgcgcccccagcccagcccctgcctcctctccaaacactttcatgcaaaacacacaacggagaagcgagcgctcccaggagccctctaggctgtggagctctgctgggagccttgagcccacacttgggcacagaggctctgcccct

SEQ ID NO: 290850 - DNA, 2366 bp, Homo sapiens
actctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgtctgttctgtccgctgccacaagttcctagtatccagggttggtgaagattggatcttcctggtcctgctggggcttctcatggcattggtcagctgggtcatggactatgccattgctgcctgtctgcaagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaaggagcagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctagccctgaggcttctgtctgcttccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaacaaaataaacacctaatgagccactta

SEQ ID NO: 290851 - DNA, 654 bp, Homo sapiens
cagggaagtcggtgcggttggccagctccgggatgacccgccgggacccgctcacaaataaggtggccctggtaacggcctccaccgactgggcttcagtccttacaatgtcagtaaaacagccttgctgggcctcaacaagaccttggccatagagctggccccaaggaacattagggtgaactgcctagcacctggacttatcaagactagcttcagcaggatgctctggatggacaaggaaaaagaggaaagcatgaaagaaaccctgcggataagaaggttaggcgagccagaggattctcttggcatcgtgtctttcctgtgctctgaagatgccagctacctcactggggaaacagtgatggtgggtggaggaaccccgtcccgcctctgaggacccggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggtgtcttactcgggattcctgctgttgttgtggccttgggtaaaggcctcccctgagaacacaggacaggcctgctgacaaggctgagtctaccttgg

SEQ ID NO: 290852 - DNA, 1651 bp, Homo sapiens
agtgacgtcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagt

SEQ ID NO: 290853 - DNA, 711 bp, Homo sapiens
tgctgggattacagacatgagccaccacgcctggccgctctgtacacatttaataaaatgtccttccttcgttgttcctacctgtgactaattctgcttctgactttcagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagt

SEQ ID NO: 290854 - DNA, 453 bp, Homo sapiens
aggatccccgacctagacgttacacagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagt

SEQ ID NO: 290855 - DNA, 668 bp, Homo sapiens
aggatccccgacctagacgttacacagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagttgcttgaacattaatgtgtcttctgtatcacttttttctcctctgaagtttttaataagcacattcattgtgaacagaaatagctggattttaggaattttgggaagatttggatctgaaaggttttatttattgacaaatttgtatctacaaaaaatcttaaaaggtgtaatcattgtcttcagaaaataaaagaaaagaaaggccagacagac

SEQ ID NO: 290856 - DNA, 946 bp, Homo sapiens
agtgacgtcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaaggtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaaggtgaggaaagtgccaccttcacaggg

SEQ ID NO: 290857 - DNA, 380 bp, Homo sapiens
  misc_feature (21)..(21): n is a, c, g, or t
  misc_feature (33)..(33): n is a, c, g, or t
aaaaaaagcggcgcgagaagncgacagaagagnggagatccacgtgaaccctcaggtacaaagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagt

SEQ ID NO: 290858 - DNA, 517 bp, Homo sapiens
  misc_feature (41)..(41): n is a, c, g, or t
ggatgcaccccgatctcgagggcactccgccccagcaagtnaaccctgtagctgcaaatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagtaaagaagaaaagcaacccaacaattctctataatttttggcctctttggcctcagggggg

SEQ ID NO: 290859 - DNA, 1866 bp, Homo sapiens
agtgacgtcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagttgcttgaacattaatgtgtcttctgtatcacttttttctcctctgaagtttttaataagcacattcattgtgaacagaaatagctggattttaggaattttgggaagatttggatctgaaaggttttatttattgacaaatttgtatctacaaaaaatcttaaaaggtgtaatcattgtcttcagaaaataaaagaaaagaaaggccagacagac

SEQ ID NO: 290860 - DNA, 1801 bp, Homo sapiens
agtgacgtcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagtaaaacaaaaacaaaaaaaatcgcgggttcaattggcgcggtgggggaaaaggggtttggaatgggccttggtcataagtggtccgacccagcttttggtcaaggggcgactcgcgggctccaaagggaggaaaatgaaagcggtacggtg

SEQ ID NO: 290861 - DNA, 1670 bp, Homo sapiens
agtgacgtcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaagtgttgttcctgttttccagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagt

SEQ ID NO: 290862 - DNA, 1567 bp, Homo sapiens
ccagctcctccgctgccaggcggcgcacgctcgggaacctgtgcgcctattttggtcctacagaatgctgcggaagctctcgctcggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagt

SEQ ID NO: 290863 - DNA, 1521 bp, Homo sapiens
agtgacgtcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaaggtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagt

SEQ ID NO: 290864 - DNA, 1719 bp, Homo sapiens
agtgacgtcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagtgacaacataagatccaatgtgctgccatctttgagaacttatctgaaagagatgtcatttctgacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagt

SEQ ID NO: 290865 - DNA, 1570 bp, Homo sapiens
agtgacgtcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagt

SEQ ID NO: 290866 - DNA, 1471 bp, Homo sapiens
agtgacgtcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaaggtttgtgaagttttctatgcccagtgttcctgacttcgaaacgctattctcacaggttcagctcttcatcagcacttgtaatggggagcacattcgatatgcaacagacacttcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagt

SEQ ID NO: 290867 - DNA, 1744 bp, Homo sapiens
agtgacgtcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagagacagagtctcgctatgttggccaggttggtgttgaactcctggcctcaagcagtccttctgcgtctgcctcccagagtgctgggattacagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagt

SEQ ID NO: 290868 - DNA, 1477 bp, Homo sapiens
agtgacgtcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagt

SEQ ID NO: 290869 - DNA, 1471 bp, Homo sapiens
agtgacgtcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagt

SEQ ID NO: 290870 - DNA, 997 bp, Homo sapiens
caagtagctgggattacaggcatgtgctatcacgctcagttaattttgtatttttagtagagacggggtttcttcatgttggtcaggctggtgtttaacccctgaccccaggtgatttgtccgcctcggcctcccaaagtgttgagattacaggcgtgagtccccacacctggcctcttctgaagttttaatctgaattttttccctcctttgcatctttagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagt

SEQ ID NO: 290871 - DNA, 513 bp, Homo sapiens
agctgtaaggatgaaagtggcatctattgagatatagaagataggagcaacattttgggggaaatatcagaaatttggttttgaatatgagaagtatgtgatgtctattagacatccaaatggaaatgtctaataagcaaattggataagcaagcctggaagtcagagagaaatgtgctgaagtcaaagctatgaggcagtgacgtgagacaggtttgaagattaagtcctgagcactctgtgcttagaggttaaggagataaggagacaccagcaaaggagactgaagaggagtgagcagtaacggaagagagaaaccagcagaccgtttcctgcaggctgggaaagaaagcgaaacaggtagactttgtggcatttgatacaacttggacaatacctagtttggagggaggggaatggaagggcatggaagtttttttaaataattaaaaatatatacatataattttgagaattgagcatttaataaactgacttttgttattatggaaa

SEQ ID NO: 290872 - DNA, 3363 bp, Homo sapiens
cttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggagtcacattaactttgctctagaagacaactttacaaggatctaaaaggaacaggattaaagatgactgaatactgggttccagaaatttaaaacaatcagcttagcaaatcatatattcttctgtggagctgagaattgatgtccgctcttccccgtgatttggaactttccaatcccagagaaaagttgacaaagggactgcccaggactgagtccatatggaagaagaacttcctcttttctctggagacagtggcaagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggtcgcctgtggctacgcacacacattagtattaacagatgaaggccaagtgtatgcttggggcgccaattcttatgggcagttgggcactggcaataaaagcaaccagtcctatcctactcctgtcactgtggaaaaggacaggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtggaacctgatgaccacctcacagtggctgagtcactgaagagggaatttgacaacccggacactgcagacctgaagtttctagttgatggaaagtacatttatgcacataaagtccttctcaagattcgatgtgagcattttcgttcgtcattggaagataacgaggatgatattgtagaaatgagtgaattttcatatcctgtttaccgggccttcctggaatacctatacacagacagcatcagcctttctcctgaggaggcagtaggactgctagacttggctacattttatagagaaaatcgtttgaaaaagctctgccaacaaactatcaagcaaggcatctgcgaggagaatgccatcgctctgctctcggctgcggtgaagtatgatgcacaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagataacagaaaaaatgtgttggggttttttttaatcccaaaacagcagcaaaattataaaatgtcaacctcatgtctcttagatgtacataaataaattggatatattatgctcttatcaagcagttactcggataaagtctcataggaaagcccaccctagaccacaaatagcttataaacaacctaattatcattc

SEQ ID NO: 290873 - DNA, 3103 bp, Homo sapiens
cttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggtcgcctgtggctacgcacacacattagtattaacagatgaaggccaagtgtatgcttggggcgccaattcttatgggcagttgggcactggcaataaaagcaaccagtcctatcctactcctgtcactgtggaaaaggacaggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtggaacctgatgaccacctcacagtggctgagtcactgaagagggaatttgacaacccggacactgcagacctgaagtttctagttgatggaaagtacatttatgcacataaagtccttctcaagattcgatgtgagcattttcgttcgtcattggaagataacgaggatgatattgtagaaatgagtgaattttcatatcctgtttaccgggccttcctggaatacctatacacagacagcatcagcctttctcctgaggaggcagtaggactgctagacttggctacattttatagagaaaatcgtttgaaaaagctctgccaacaaactatcaagcaaggcatctgcgaggagaatgccatcgctctgctctcggctgcggtgaagtatgatgcacaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagataacagaaaaaatgtgttggggttttttttaatcccaaaacagcagcaaaattataaaatgtcaacctcatgtctcttagatgtacataaataaattggatatattatgctcttatcaagcagttactcggataaagtctcataggaaagcccaccctagaccacaaatagcttataaacaacctaattatcattc

SEQ ID NO: 290874 - DNA, 3202 bp, Homo sapiens
cttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggagtcacattaactttgctctagaagacaactttacaaggatctaaaaggaacaggattaaagatgactgaatactgggttccagaaatttaaaacaatcagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggtcgcctgtggctacgcacacacattagtattaacagatgaaggccaagtgtatgcttggggcgccaattcttatgggcagttgggcactggcaataaaagcaaccagtcctatcctactcctgtcactgtggaaaaggacaggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtggaacctgatgaccacctcacagtggctgagtcactgaagagggaatttgacaacccggacactgcagacctgaagtttctagttgatggaaagtacatttatgcacataaagtccttctcaagattcgatgtgagcattttcgttcgtcattggaagataacgaggatgatattgtagaaatgagtgaattttcatatcctgtttaccgggccttcctggaatacctatacacagacagcatcagcctttctcctgaggaggcagtaggactgctagacttggctacattttatagagaaaatcgtttgaaaaagctctgccaacaaactatcaagcaaggcatctgcgaggagaatgccatcgctctgctctcggctgcggtgaagtatgatgcacaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagataacagaaaaaatgtgttggggttttttttaatcccaaaacagcagcaaaattataaaatgtcaacctcatgtctcttagatgtacataaataaattggatatattatgctcttatcaagcagttactcggataaagtctcataggaaagcccaccctagaccacaaatagcttataaacaacctaattatcattc

SEQ ID NO: 290875 - DNA, 2075 bp, Homo sapiens
agctgtaaggatgaaagtggcatctattgagatatagaagataggagcaacattttgggggaaatatcagaaatttggttttgaatatgagaagtatgtgatgtctattagacatccaaatggaaatgtctaataagcaaattggataagcaagcctggaagtcagagagaaatgtgctgaagtcaaagctatgaggcagtgacgtgagacaggtttgaagattaagtcctgagcactctgtgcttagaggttaaggagataaggagacaccagcaaaggagactgaagaggagtgagcagtaacggaagagagaaaccagcagaccgtttcctgcaggctgggaaagaaagcgaaacaggaaggaagaagtccgaaccacaccagatgctgctggcacgtctgcacgaggactgagaactgacgagtgggtttggcgatgagaacgccggaggggccttggcaagcagttttagcgcagtgaggcgggaagtctgatcggagcgtggaagtagaggaactgaagatggggaatagaggcagcttttcatggtaattttattataaagataaaaaggaagagctttggggcatttgaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagataacagaaaaaatgtgttggggttttttttaatcccaaaacagcagcaaaattataaaatgtcaacctcatgtctcttagatgtacataaataaattggatatattatgctcttatcaagcagttactcggataaagtctcataggaaagcccaccctagaccacaaatagcttataaacaacctaattatcattc

SEQ ID NO: 290876 - DNA, 2028 bp, Homo sapiens
agctgtaaggatgaaagtggcatctattgagatatagaagataggagcaacattttgggggaaatatcagaaatttggttttgaatatgagaagtatgtgatgtctattagacatccaaatggaaatgtctaataagcaaattggataagcaagcctggaagtcagagagaaatgtgctgaagtcaaagctatgaggcagtgacgtgagacaggtttgaagattaagtcctgagcactctgtgcttagaggttaaggagataaggagacaccagcaaaggagactgaagaggagtgagcagtaacggaagagagaaaccagcagaccgtttcctgcaggctgggaaagaaagcgaaacaggaaggaagaagtccgaaccacaccagatgctgctggcacgtctgcacgaggactgagaactgacgagtgggtttggcgatgagaacgccggaggggccttggcaagcagttttagcgcagtgaggcgggaagtctgatcggagcgtggaagtagaggaactgaagatggggaatagaggcagcttttcatggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagataacagaaaaaatgtgttggggttttttttaatcccaaaacagcagcaaaattataaaatgtcaacctcatgtctcttagatgtacataaataaattggatatattatgctcttatcaagcagttactcggataaagtctcataggaaagcccaccctagaccacaaatagcttataaacaacctaattatcattc

SEQ ID NO: 290877 - DNA, 2139 bp, Homo sapiens
agctgtaaggatgaaagtggcatctattgagatatagaagataggagcaacattttgggggaaatatcagaaatttggttttgaatatgagaagtatgtgatgtctattagacatccaaatggaaatgtctaataagcaaattggataagcaagcctggaagtcagagagaaatgtgctgaagtcaaagctatgaggcagtgacgtgagacaggtttgaagattaagtcctgagcactctgtgcttagaggttaaggagataaggagacaccagcaaaggagactgaagaggagtgagcagtaacggaagagagaaaccagcagaccgtttcctgcaggctgggaaagaaagcgaaacaggaaggaagaagtccgaaccacaccagatgctgctggcacgtctgcacgaggactgagaactgacgagtgggtttggcgatgagaacgccggaggggccttggcaagcagttttagcgcagtgaggcgggaagtctgatcggagcgtggaagtagaggaactgaagatggggaatagaggcagcttttcatggtaattttattataaagataaaaaggaagagctttggggcatttgagatctgtgaggcatcaaactgcccagccacctaactccagacacactctaatgtgtgtggtgtaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagataacagaaaaaatgtgttggggttttttttaatcccaaaacagcagcaaaattataaaatgtcaacctcatgtctcttagatgtacataaataaattggatatattatgctcttatcaagcagttactcggataaagtctcataggaaagcccaccctagaccacaaatagcttataaacaacctaattatcattc

SEQ ID NO: 290878 - DNA, 1793 bp, Homo sapiens
gaggagtatagggcttttaacaattattgaaagtgaaatcaacagttacaaatactgtcactagacaaaggtaccaaggaattcacacactcacatgcctatctctgggaagagctacttaaatttttacaagcatagatgattcatacttgttatactttttatgactattctttaggtattaccatgccatcatttcctccacttgcctattaaatcctttttctttgcctaacttgttttagcgattttcatgctatgttgcattgaattagtaaatatgaatttattaaaccatctttgttgttgttcctaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagataacagaaaaaatgtgttggggttttttttaatcccaaaacagcagcaaaattataaaatgtcaacctcatgtctcttagatgtacataaataaattggatatattatgctcttatcaagcagttactcggataaagtctcataggaaagcccaccctagaccacaaatagcttataaacaacctaattatcattc

SEQ ID NO: 290879 - DNA, 1363 bp, Homo sapiens
cttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggagtcacattaactttgctctagaagacaactttacaaggatctaaaaggaacaggattaaagatgactgaatactgggttccagaaatttaaaacaatcagcttagcaaatcatatattcttctgtggagctgagaattgatgtccgctcttccccgtgatttggaactttccaatcccagagaaaagttgacaaagggactgcccaggactgagtccatatggaagaagaacttcctcttttctctggagacagtggcaagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggtcgcctgtggctacgcacacacattagtattaacagatgaaggccaagtgtatgcttggggcgccaattcttatgggcagttgggcactggcaataaaagcaaccagtcctatcctactcctgtcactgtggaaaaggacaggtaacacgggcattttcacagtccccacactggtctttggtgattgtgattaaacaggacttagat

SEQ ID NO: 290880 - DNA, 421 bp, Homo sapiens
gggcggcggtgggcagcctagggaggagaggaggggcgagacgccgtcgccagccccctcctcttgtctgcgctcccttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggaggtaagagggtggaggagtggtgtgggaggccgagggggatcgcggccgtgacgtgggatgctgtcaggtaccactggggcaggccacccctccccgcccctgcggcccgacctccccgccagagacagctgaggggcccaggggactagagccgcgaccgtgccacaggcctaggcgtcgtcgcgcatgcgt

SEQ ID NO: 290881 - DNA, 454 bp, Homo sapiens
ctcacaaaacaggcttcctccagaggttcctttaagggcagtaaaatttcccagaacttgaacccataactccacactctgagacaagaatttcctctactcctttcaaggataaatgaggcaagaaagcttcaagttgagcttttccaatctgattgcgaacttgatgacaactgaagatacaatgcctggtttttctcagtagttctgctccaacagtctaaaacgcaatcacaaaagacacgttgtttcaaatggaaattctatcctgaaatgattcactccagcacaaactgaaaacccatccccgatggaccttgactaaccgtaatgatctcaatgtctgcaatttcctgtcaaatatgagaacaacatcccaaagtgggagaacagatgaaacaagacggataaaatactgagaagtcttgaatataagtgataggtacctgagagt

SEQ ID NO: 290882 - DNA, 510 bp, Homo sapiens
agaactcacaaaggtttttaggtacaaagaccttcctcatggctttatctgagtggtggggaagtgagggcaacttaggtattcattatcacagatggagaagaaccatatgatagatgctcactctgggaagattggttagtggctcaccaagtctatctccttttcttccaagacacacaaatagactacattttccagtcttcattgcagttaggcacaaccatttgactgaggtctagtcaaagaatatgaatggaaatgatgttgctattccaggcccatgaaaacctctcacacaagatatttatgcctttcaccttctgccaatgcaatgcaggtggatgcgaccatcttggaagccatgttaaagaaggcagagccacaagatagatgcagccgggttctctaaatcaccactggggagaaacccacacaccaatgaggaatacccattttttggattttaagagcaagaaataaacttcaattgtgttcagcaaaatgtgc

SEQ ID NO: 290883 - DNA, 371 bp, Homo sapiens
cactgcctcctcctgcgctttccgcccttcgccgtccctgactggaggaaacctgcaggctctcgtccgccgagctcagaagtgccaggcgctgccaacggccccggagatcctcgcgcattatagtggcctatgagcagaatttgccatgccttccatggagcattctttttccaagtcaggtcaatccagcctgcagctgtggatgcgaccatcttggaagccatgttaaagaaggcagagccacaagatagatgcagccgggttctctaaatcaccactggggagaaacccacacaccaatgaggaatacccattttttggattttaagagcaagaaataaacttcaattgtgttcagcaaaatgtgc

SEQ ID NO: 290884 - DNA, 615 bp, Homo sapiens
gatagataagcactgaaataaaaataatgtttttatttccttaagtcttttttgttctttttatatattatttatttaattttttgagatagcatctcactctgctgcccaggctggagtgcagtggtgccatctaggctcactgcaacctctgcctccccggttcaatcaattctcctgcctcagtctcctgagtagctaagattacaggcatgagccaccttgcccggctaatctttgtatttttagtagtaggggtttctccatgctggtcaggctggtctcaaactcctgacctcaggtgatccgcccaccttggcctcctaaagtgctgggattacaggcgtgagcggacgtgcacccggccttctttttatattttaaaagtaaacctccttttaaaatttttccatgtcactgaaatgatgttgaagagtgaatattctaagagctacacagagatttgtaaacagctgaaccaattttctgctggattattaggctgtttctaaatttttactaagttacaataattataagtagtctgtgcaacagtcaatttctttagtgtaacacatgaacgaaaagctatacacttttttttttttttcagac

SEQ ID NO: 290885 - DNA, 2381 bp, Homo sapiens
gccggctcgggctccgcgagtcctcctttttgcacacacacgaatacaaagagccatacgaccttcggatgccggaaggtccttctgaatcccttccctgttccttaggttgcactagtcgggggttccatgctggggggcagaaggaatgctctctaccgtctgaaaccgttcatcaggaaggccttgatttgtgatgtgctaggagagcacaggatctgcaaatagaaggcacctgtctcccttctgcaggccgaggagaggccgccatggactgtgtgcttcttcatggcttgtttactcttctttcacagaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagatgctctgtgcagtctgagaaagcgaatttgcctcttttcttaacacagtctctactggggaagcagaacactggtgggataaaaacttatctagaaggggagaaactccctccactgtgaacagtaagccagaatatgcttattcctcagcataaacagtatctcggagaagcctgggatgagaaaatgaggaggatgggtccaagaaacatgaggccttcttgacataagc

SEQ ID NO: 290886 - DNA, 2135 bp, Homo sapiens
gccggctcgggctccgcgagtcctcctttttgcacacacacgaatacaaagagccatacgaccttcggaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagatgctctgtgcagtctgagaaagcgaatttgcctcttttcttaacacagtctctactggggaagcagaacactggtgggataaaaacttatctagaaggggagaaactccctccactgtgaacagtaagccagaatatgcttattcctcagcataaacagtatctcggagaagcctgggatgagaaaatgaggaggatgggtccaagaaacatgaggccttcttgacataagc

SEQ ID NO: 290887 - DNA, 2238 bp, Homo sapiens
gctgtacgcccggattaacgggatcaagagccatacgaccttcggatgccggaaggtccttctgaatcccttccctgttccttaggttgcactagtcgggggttccatgctggggggcagaaggaatgctctctaccgtctgaaaccgttcatcaggaaggccttgatttgtgatgtgctaggagagcacaggatctgcaaatagaaggcacctgtctcccttctgcaggccgaggagaggccgccatggactgtgtgcttcttcatggcttgtttactcttctttcacagaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagatgctctgtgcagtctgagaaagcgaatttgcctcttttcttaacacagtctctactggggaagcagaacactggtgggataaaaacttatctagaaggggagaaactccctccactgtgaacagtaagccagaatatgcttattcctcagcataaacagtatctcggagaagcctgggatgagaaaatgaggaggatgggtccaagaaacatgaggccttcttgacataagc

SEQ ID NO: 290888 - DNA, 2358 bp, Homo sapiens
gctgtacgcccggattaacgggatcaagagccatacgaccttcggatgccggaaggtccttctgaatcccttccctgttccttaggttgcactagtcgggggttccatgctggggggcagaaggaatgctctctaccgtctgaaaccgttcatcaggaaggccttgatttgtgatgtgctaggagagcacaggatctgcaaatagaaggcacctgtctcccttctgcaggccgaggagaggccgccatggactgtgtgcttcttcatggcttgtttactcttctttcacagaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagatgctctgtgcagtctgagaaagcgaatttgcctcttttcttaacacagtctctactggggaagcagaacactggtgggataaaaacttatctagaaggggagaaactccctccactgtgaacagtaagccagaatatgcttattcctcagcataaacagtatctcggagaagcctgggatgagaaaatgaggaggatgggtccaagaaacatgaggccttcttgacataagc

SEQ ID NO: 290889 - DNA, 2046 bp, Homo sapiens
gctgtacgcccggattaacgggatcaagagccatacgaccttcggatgccggaaggtccttctgaatcccttccctgttccttaggttgcactagtcgggggttccatgctggggggcagaaggaatgctctctaccgtctgaaaccgttcatcaggaaggccttgatttgtgatgtgctaggagagcacaggatctgcaaatagaaggcacctgtctcccttctgcaggccgaggagaggccgccatggactgtgtgcttcttcatggcttgtttactcttctttcacagaccctacagcttggggcctgggctcctctgaccatcctcattgagaaaggaaagtgagtccagagaagttgatgcttcctacctgttggagcggcccagcagtgaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagatgctctgtgcagtctgagaaagcgaatttgcctcttttcttaacacagtctctactggggaagcagaacactggtgggataaaaacttatctagaaggggagaaactccctccactgtgaacagtaagccagaatatgcttattcctcagcataaacagtatctcggagaagcctgggatgagaaaatgaggaggatgggtccaagaaacatgaggccttcttgacataagc

SEQ ID NO: 290890 - DNA, 2304 bp, Homo sapiens
gctgtacgcccggattaacgggatcaagagccatacgaccttcggatgccggaaggtccttctgaatcccttccctgttccttaggttgcactagtcgggggttccatgctggggggcagaaggaatgctctctaccgtctgaaaccgttcatcaggaaggccttgatttgtgatgtgctaggagagcacaggatctgcaaatagaaggcacctgtctcccttctgcaggccgaggagaggccgccatggactgtgtgcttcttcatggcttgtttactcttctttcacagaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagatgctctgtgcagtctgagaaagcgaatttgcctcttttcttaacacagtctctactggggaagcagaacactggtgggataaaaacttatctagaaggggagaaactccctccactgtgaacagtaagccagaatatgcttattcctcagcataaacagtatctcggagaagcctgggatgagaaaatgaggaggatgggtccaagaaacatgaggccttcttgacataagc

SEQ ID NO: 290891 - DNA, 2219 bp, Homo sapiens
gccggctcgggctccgcgagtcctcctttttgcacacacacgaatacaaagagccatacgaccttcgggtatcctttttccattttttttcctccttaatcttgtgtgtgttttcaaattttttaaaaatagagatctgtagcagtgttgggaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagatgctctgtgcagtctgagaaagcgaatttgcctcttttcttaacacagtctctactggggaagcagaacactggtgggataaaaacttatctagaaggggagaaactccctccactgtgaacagtaagccagaatatgcttattcctcagcataaacagtatctcggagaagcctgggatgagaaaatgaggaggatgggtccaagaaacatgaggccttcttgacataagc

SEQ ID NO: 290892 - DNA, 1902 bp, Homo sapiens
gccggctcgggctccgcgagtcctcctttttgcacacacacgaatacaaagagccatacgaccttcggtttcaggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagatgctctgtgcagtctgagaaagcgaatttgcctcttttcttaacacagtctctactggggaagcagaacactggtgggataaaaacttatctagaaggggagaaactccctccactgtgaacagtaagccagaatatgcttattcctcagcataaacagtatctcggagaagcctgggatgagaaaatgaggaggatgggtccaagaaacatgaggccttcttgacataagc

SEQ ID NO: 290893 - DNA, 378 bp, Homo sapiens
tcatgattgtcatgattgttaatgtcaacaaaaagtggtatcagttaaaaaaaaatacaacactacattgaaagtagcaataactggattctgctgttattcctctgaccttgaaaaagacatataacttctccacatgtctcttctctggacctggagtaatatgtttcctagtgctgttgagtagatgaggtaacttatgtgaagtgttctgaacaccttaaggaacaatgtcaaagcaatgaaatgcagtaccattattacagtaaagatggtgaggaggaggaggagacagatctacattttcttccttaatcttctaatctttccagatgccggaaggtccttctgaatcccttccctgttccttaggttgca

SEQ ID NO: 290894 - DNA, 349 bp, Homo sapiens
cagagggacatgcggctcccagggtgcacgctggctgccagcgaggcggcccccctgctcaatcctgtgagtatggcagcagagggctattcctcctaggtgcttttcctggcttttcactctttttcctttctgttcttttctttccatctttaaaccttttgtttgtatttgtgataaagcaaaacagtaccacgtttccttttccttcagggatagtcagctctattttcttcctgaaccatcagcttctttggcagaaggtcattttttgctgtgtgtagtgatggggtgcccttccctctctctcagtagctccgcatggcaccttctcttccacagctgtctc

SEQ ID NO: 290895 - DNA, 521 bp, Homo sapiens
tgaggaactgaatctttcctttcattttaattaatttaaatttaaatggccacatgtggctagtggctaccatattggacagcacagctctagatgcatttcaggtgttattcccatgagattcccaaataaacttcctgcatgcaaatctccatctcagcatctgtttccctgaggaggaaccaacctaaaatgaattgcaaattaaaatctcaaagtgagtcaaagcaaccagaatttcccttcccaagaggggaccagccccatacccatgaggaaaggatgctacacagagaagccaagaagagtctgcatggataggccttactggcttcctcacctgagtgtatcaccattaattagatgatacctctttgtccaatcacatttctacatggctgtccccagtttaaggacaaaaacagacagtctccccttgagtctttgagtcttcatttttgaaggcttccatgtcacaaaaaaatctttgattaaataaattgatgtttttctcttgtaaa

SEQ ID NO: 290896 - DNA, 410 bp, Homo sapiens
tgaggaactgaatctttcctttcattttaattaatttaaatttaaatggccacatgtggctagtggctaccatattggacagcacagctctagatgcatttcaggtgttattcccatgagattcccaaataaacttcctgcatgcaaatctccatctcagcatctgtttccctgaggaggaaccaacctaaaatgaattgcaaattaaaatctcaaagtgagtcaaagcaaccagaatttcccttcccaaggagtatcagctgtgacccttatgatgggtgagggcatgtcggtgatgaaactatcactactgttcaaggtgccagaagtttgacttaccatcgcttttgaacaatcatcactacatgtcagcgtgggaaaaagaataaaataacatcttaatattatta

SEQ ID NO: 290897 - DNA, 1164 bp, Homo sapiens
ccaaacctgagactgggtgactcttgcctaggctcacagatcgagccttcccagtgttgcactgggaccctagggtggccctggggtgcccaagagatgcgcaagcatctcgcgccttccaagcgatcagcgaggaaaaacggggtccaaattcgagtagaatctgcgggttgcgggaagatggcctgcgagtgcggtgggggacaataccctagggccccgtgcgccctcgctttcccggggcactctcaccatttgtagcctctgccgcgcttgaacttgagggtgagcgcagtctccaggaagagcaagaggttgagcagcgcaagcagccagtaccgcggctccttcttcacctcggtcactcgccagaccccgaccagcgagtgcagcaggaacagcaaccgagtggccagggcgttaaggaagaccagtccctccatgctggccggagcactctgcctacgtccccttgcctgcgcccccaggaccctgccgggcgtgcccggagcccaccggtgagcaggaatatgacaagcactgagacctgctgctgcttgtggtcccttctcaccctcagcgcccgatgccggtagaactggtgcgcggctcgcccctcccccaaacttcctgagaactcttcaaagagggttgtgatttgaagagtaaccttcttcagaaaactgtggagacttcacagaaatggcagaagctagttgaagtctacaaattacctaatggaacagggtgttattcccatgagattcccaaataaacttcctgcatgcaaatctccatctcagcatctgtttccctgaggaggaaccaacctaaaatgaattgcaaattaaaatctcaaagtgagtcaaagcaaccagaatttcccttcccaagaggggaccagccccatacccatgaggaaaggatgctacacagagaagccaagaagagtctgcatggataggccttactggcttcctcacctgagtgtatcaccattaattagatgatacctctttgtccaatcacatttctacatggctgtccccagtttaaggacaaaaacagacagtctccccttgagtctttgagtcttcatttttgaaggcttccatgtcacaaaaaaatctttgattaaataaattgatgtttttctcttgtaaa

SEQ ID NO: 290898 - DNA, 446 bp, Homo sapiens
ggtattcggagaccttcagaagcctggtcacggagggcctgcccagggacccccctgcctctccccccaggccccacggcggcagagactcacaggcaaagaactgccagggctggtaggtgcggccgaagtccatggaccgctccagcacccagaggtccggccgggacaggggccctggacagctgtcctcgagggcctggtggctgcacagatggtcacaggaagggaagcccgcgctggaggactcccatctgtctctgacctggtcgcggctcccagggccacaccggccgccctcgccatgacccggagcgagcgcagacccctggcttcgggaccgcccttccccctccacgccccgctcagctcagctgccagtgctgacctttccgctgctacatggttctgtgcagaaagaaaaaaaaaagtcttttaaagcaaaa

SEQ ID NO: 290899 - DNA, 699 bp, Homo sapiens
cggaagcggagaggcggtcgggatccgctgcgcgagctgtctcggtcccacgtgtgcggtgagtgtggcaggctcagcggtcgctcagccccctgagtagctgggattacatgtttgcaacaccaccatgcccagctaaattttgtatttttagtagagatggggtttggtcttgaactcctgacctcaggtaatccacctgcctcagcctcccaaagtgctgggattacaggtgtgagccaccatgcaagcctctaagtaactttggaaaagtattttgaatggatacaaaaaagaattgtacgtcaacactgtactgtcattgtaaatttatttctcacggggtacaggttagcaattctgaaactatgcatgtatagtagggtggaatatgtgtataaataaattgtagatggtgggaagcaggttgctcactgtcagagaaggaagttacaaatgagcaagaggagatgcctggaggaaaatatgtggtgcttgattagatttggaaacatcagtatgagcttcaagttattgtaatagatataaaaataaatataggtatgtgcatatgcataagttaatatacatatatgtgtttcctgaatctgtctgccgaaaggacatagaaacagggacacctcagtgacaacaagtgcgcctagcactcagatcttggtttttaaataccattctcaa

SEQ ID NO: 290900 - DNA, 2182 bp, Homo sapiens
cggaagcggagaggcggtcgggatccgctgcgcgagctgtctcggtcccacgtgtgcgagttgctacgatggaagttaaagggaaaaagcaattcacaggaaagagtacaaagacagcacaagaaaaaaacagatttcataaaaatagtgattctggttcttcaaagacatttccaacaaggaaagttgctaaagaaggtggacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccaagaagcccaaatgggatgacttcaaaaagaagaagaaagaactgaagcaaagcagacaactcagtgataaaaccaactatgacattgttgttcgggcaaagcagatgtgggagattttaagaagaaaagactgtgacaaagaaaaaagagtaaagttaatgagtgatttgcagaagttgattcaagggaaaattaaaactattgcatttgcacacgattcaactcgtgtgatccagtgttacattcagtatggtaatgaagaacagagaaaacaggcttttgaagaattgcgagatgatttggttgagttaagtaaagccaaatattcgagaaatattgttaagaaatttctcatgtatggaagtaaaccacagattgcagagataatcagaagttttaaaggccacgtgaggaagatgctgcggcatgcggaagcatcagccatcgtggagtacgcatacaatgacaaagccattttggagcagaggaacatgctgacggaagagctctatgggaacacatttcagctttacaagtcagcagatcaccgaactctggacaaagtgttagaggtacagccagaaaaattagaacttattatggatgaaatgaaacagattctaactccaatggcccaaaaggaagctgtgattaagcactcattggtgcataaagtattcttggacttttttacctatgcaccccccaaactcagatcagaaatgattgaagccatccgcgaagcggtggtctacctggcacacacacacgatggcgccagagtggccatgcactgcctgtggcatggcacgcccaaggacaggaaagtgattgtgaaaacaatgaagacttatgttgaaaaggtggctaatggccaatactcccatttggttttactggcggcatttgattgtattgatgatactaagcttgtgaagcagataatcatatcagaaattatcagttcattgcctagcatagtaaatgacaaatatggaaggaaggtcctattgtacttactaagccccagagatcctgcacatacagtacgagaaatcattgaagttctgcaaaaaggagatggaaatgcacacagtaagaaagatacagaggtccgcagacgggagctcctagaatccatttctccagctttgttaagctacctgcaagaacacgcccaagaagtggtgctagataagtctgcgtgtgtgttggtgtctgacattctgggatctgccactggagacgttcagcctaccatgaatgccatcgccagcttggcagcaacaggactgcatcctggtggcaaggacggagagcttcacattgcagaacatcctgcaggacatctagttctgaagtggttaatagagcaagataaaaagatgaaagaaaatgggagagaaggttgttttgcaaaaacacttgtagagcatgttggtatgaagaacctgaagtcctgggctagtgtaaatcgaggtgccattattctttctagcctcctccagagttgtgacctggaagttgcaaacaaagtcaaagctgcactgaaaagcttgattcctacattggaaaaaaccaaaagcaccagcaaaggaatagaaattctacttgaaaaactgagcacataggtggaaagagttaagagcaagatggaatgattttttctgttctctgttctgtttcccaatgcagaaaagaaggggtagggtccaccatactggtaattggggtactctgtatatgtgtttcttctttgtatacgaatctatttatataaattgtttttttaaatggt

SEQ ID NO: 290901 - DNA, 2221 bp, Homo sapiens
cggaagcggagaggcggtcgggatccgctgcgcgagctgtctcggtcccacgtgtgcgagttgctacgatggaagttaaagggaaaaagcaattcacaggaaagagtacaaagacagcacaagaaaaaaacagatttcataaaaatagtgattctggttcttcaaagacatttccaacaaggaaagttgctaaagaaggtggacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccaagaagcccaaatgggatgacttcaaaaagaagaagaaagaactgaagcaaagcagacaactcagtgataaaaccaactatgacattgttgttcgggcaaagcagatgtgggagattttaagaagaaaagactgtgacaaagaaaaaagagtaaagttaatgagtgatttgcagaagttgattcaagggaaaattaaaactattgcatttgcacacgattcaactcgtgtgatccagtgttacattcagtatggtaatgaagaacagagaaaacaggcttttgaagaattgcgagatgatttggttgagttaagtaaagccaaatattcgagaaatattgttaagaaatttctcatgtatggaagtaaaccacagattgcagagataatcagaagttttaaaggccacgtgaggaagatgctgcggcatgcggaagcatcagccatcgtggagtacgcatacaatgacaaagccattttggagcagaggaacatgctgacggaagagctctatgggaacacatttcagctttacaagtcagcagatcaccgaactctggacaaagtgttagaggtacagccagaaaaattagaacttattatggatgaaatgaaacagattctaactccaatggcccaaaaggaagctgtgattaagcactcattggtgcataaagtattcttggacttttttacctatgcaccccccaaactcagatcagaaatgattgaagccatccgcgaagcggtggtctacctggcacacacacacgatggcgccagagtggccatgcactgcctgtggcatggcacgcccaaggacaggaaagtgattgtgaaaacaatgaagacttatgttgaaaaggtggctaatggccaatactcccatttggttttactggcggcatttgattgtattgatgatactaagcttgtgaagcagataatcatatcagaaattatcagttcattgcctagcatagtaaatgacaaatatggaaggaaggtcctattgtacttactaagccccagagatcctgcacatacagtacgagaaatcattgaagttctgcaaaaaggagatggaaatgcacacagtaagaaagatacagaggtccgcagacgggagctcctagaatccatttctccagctttgttaagctacctgcaagaacacgcccaagaagtggtgctagataagtctgcgtgtgtgttggtgtctgacattctgggatctgccactggagacgttcagcctaccatgaatgccatcgccagcttggcagcaacaggactgcatcctggtggcaaggacggagagcttcacattgcagaacatcctgcaggacatctagttctgaagtggttaatagagcaagataaaaagatgaaagaaaatgggagagaaggttgttttgcaaaaacacttgtagagcatgttggtatgaagaacctgaagtcctgggctagtgtaaatcgaggtgccattattctttctagcctcctccagagttgtgacctggaagttgcaaacaaagtcaaagctgcactgaaaagcttgattcctacattggaaaaaaccaaaagcaccagcaaaggaatagaaattctacttgaaaaactgagcacataggtggaaagagttaagagcaagatggaatgattttttctgttctctgttctgtttcccaatgcagaaaagaagggaacatccagtcatcaagttccaatgtgttgggcgtgaagtcatcattagacaggatgacctttcatcacttggaatatgatcagagaagcagaatttgcctagctcattcagaagaacatcgtatcatcctg

SEQ ID NO: 290902 - DNA, 1964 bp, Homo sapiens
cggaagcggagaggcggtcgggatccgctgcgcgagctgtctcggtcccacgtgtgcgagttgctacgatggaagttaaagggaaaaagcaattcacaggaaagagtacaaagacagcacaagaaaaaaacagatttcataaaaatagtgattctggttcttcaaagacatttccaacaaggaaagttgctaaagaaggtggacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccaagaagcccaaatgggatgacttcaaaaagaagaagaaagaactgaagcaaagcagacaactcagtgataaaaccaactatgacattgttgttcgggcaaagcagatgtgggagattttaagaagaaaagactgtgacaaagaaaaaagagtaaagttaatgagtgatttgcagaagttgattcaagggaaaattaaaactattgcatttgcacacgattcaactcgtgtgatccagtgttacattcagtatggtaatgaagaacagagaaaacaggcttttgaagaattgcgagatgatttggttgagttaagtaaagccaaatattcgagaaatattgttaagaaatttctcatgtatggaagtaaaccacagattgcagagataatcagaagttttaaaggccacgtgaggaagatgctgcggcatgcggaagcatcagccatcgtggagtacgcatacaatgacaaagccattttggagcagaggaacatgctgacggaagagctctatgggaacacatttcagctttacaagtcagcagatcaccgaactctggacaaagtgttagaggtacagccagaaaaattagaacttattatggatgaaatgaaacagattctaactccaatggcccaaaaggaagctgtgattaagcactcattggtgcataaagtattcttggacttttttacctatgcaccccccaaactcagatcagaaatgattgaagccatccgcgaagcggtggtctacctggcacacacacacgatggcgccagagtggccatgcactgcctgtggcatggcacgcccaaggacaggaaagtgattgtgaaaacaatgaagacttatgttgaaaaggtggctaatggccaatactcccatttggttttactggcggcatttgattgtattgatgatactaagcttgtgaagcagataatcatatcagaaattatcagttcattgcctagcatagtaaatgacaaatatggaaggaaggtcctattgtacttactaagccccagagatcctgcacatacagtacgagaaatcattgaagttctgcaaaaaggagatggaaatgcacacagtaagaaagatacagaggtccgcagacgggagctcctagaatccatttctccagctttgttaagctacctgcaagaacacgcccaagaagtggtgctagataagtctgcgtgtgtgttggtgtctgacattctgggatctgccactggagacgttcagcctaccatgaatgccatcgccagcttggcagcaacaggactgcatcctggtggcaaggacggagagcttcacattgcagaacatcctgcaggacatctagttctgaagtggttaatagagcaagataaaaagatgaaagaaaatgggagagaaggttgttttgcaaaaacacttgtagagcatgttggtatgaagaacctgaagtcctgggctagtgtaaatcgaggtgccattattctttctagcctcctccagagttgtgacctggaagttgtaaacaaagacacaacacacacatgcacacacagcacacacacgcgaacacag

SEQ ID NO: 290903 - DNA, 1646 bp, Homo sapiens
cggaagcggagaggcggtcgggatccgctgcgcgagctgtctcggtcccacgtgtgcgagttgctacgatggaagttaaagggaaaaagcaattcacaggaaagagtacaaagacagcacaagaaaaaaacagatttcataaaaatagtgattctggttcttcaaagacatttccaacaaggaaagttgctaaagaaggtggacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccaagaagcccaaatgggatgacttcaaaaagaagaagaaagaactgaagcaaagcagacaactcagtgataaaaccaactatgacattgttgttcgggcaaagcagatgtgggagattttaagaagaaaagactgtgacaaagaaaaaagagtaaagttaatgagtgatttgcagaagttgattcaagggaaaattaaaactattgcatttgcacacgattcaactcgtgtgatccagtgttacattcagtatggtaatgaagaacagagaaaacaggcttttgaagaattgcgagatgatttggttgagttaagtaaagccaaatattcgagaaatattgttaagaaatttctcatgtatggaagtaaaccacagattgcagagataatcagaagttttaaaggccacgtgaggaagatgctgcggcatgcggaagcatcagccatcgtggagtacgcatacaatgacaaagccattttggagcagaggaacatgctgacggaagagctctatgggaacacatttcagctttacaagtcagcagatcaccgaactctggacaaagtgttagaggtacagccagaaaaattagaacttattatggatgaaatgaaacagattctaactccaatggcccaaaagtaagaaagttgtttttgttttgttcttaagaaatgacattcaaaggaggaaggttttccataactgttgcccagaagaggtagctatttcctgcttacaagtattaatctattctaaataagagtgcaaaagtgttggtttgaaaccattcttggtgcaaaaggagatttctttttctgatattgtaccctataaaatgataactaacatgcattcgtgatttatgagcttttttaagcaatgaaacattctttccccaaataaaatgttacatggaagccatgtatactaaacagtttcacaaatataatctgttactcaaatttggttgtaggcaaggtacagtggctcacgcctataattctagcactttggggaaccaagctgggagaatcacttgaggccaggagttcaagaccatctggggcaatagcaagaccccatctctacgaaaaaataagaaaattagccaggctttatggcatgtgtgtatagtcttggctacttgggaggctgagaggcaggaggctcactggagcccaggaggtcatggctgcagtgagccatggttgtgccactgcattccagcctaggcaacagagtgagaccttgccttaaaaa

SEQ ID NO: 290904 - DNA, 584 bp, Homo sapiens
ttagtgtcactgtggcttgacatgtacagtagtctggaggaagctcttttcggttgagagatatggacccaagttttgatgccctctaatttaactactgtatgagacatacaatgaatgtgataggattttttttttttttcccggggggctccggtgcagttttccatttgatgtctttttccgaacatccagtcatcaagttccaatgtgttgggcgtgaagtcatcattagacagtgagtctctgaagacttatttaatcttgtgtgtaaatatacttgtggaatatttgaattaattgcttaaataatattggattggtgtcaggagttaataaggtactggcatgaacagtggggttcgttgtcattaaaacgcatggataaatcaatgtaacaattctcataagggagtcactttatgttttctaaagtggtgtggatcataaggagctaagggcaacaccttaggccaggtgtaatcctggggttacagtaagggtttggcgggtcctaattttagaaggccattggttcattcaaccttggctgaagacggggggtactggggataataataata

SEQ ID NO: 290905 - DNA, 1102 bp, Homo sapiens
gaatgggatctgttttccatcaatgtgatttattttgtgaatgtcttaagttgggtcctagaagcggagtctgagacaaggattctggggtaagtgatttattgagggaggctctcaggagaaaccaagaaggaggtgagggaagcgagggaggtacagcagaggaataaactcagcaaagatgcggggtcggctgatgtccagcctcggcctgattccaggcagctctggatatgaatggcaccaccgaagttgtcccaccttgaggcaagggggcctgtcatcagctgtgggctacccctggtcaggcaaggcataaccaccgggcattttcagcaatagcaactgtgagctgtttagtagtcaatgctctgagcagctgcaggctggctctcctaaaggtctcccaagcagaggaagagaaatcatagcgacggattcttaagggtgaaaaagacggcggtcccacagaatctggctacatccctctggaacatttgcattttgataaaggacttgcttttggagctaaggagtgaatcatttattgcaaattatgtggcattttcagaagaagtaaaataatatatagaaatgtacacaaaggaaagtcatatctgcaaacgagtcccttatctgccaagcctctcctctaccattgtaattaaccactgttattagctcctcctgtaactttcctgagtttctttacccatatataagcaaacatgaatgtgtgtattcttgctgtccactgtttcttcttcttttagcattttaattagcagatagcatattatacatactgtttggaactttgcatttttcttttttttaattttaaattttaagtgttgtgggtacatagtaggtgtatatgcatttttcttttaatagtacatctagtggttctttccaaaatagtacaaaaaagtgttctcatacaaaaaaattagccgggcatggtggtgtgtacctgtaatcccagctacttgggaggctgaggcaagagaatcgcttgaaactgggaggcaggggttggagtgagccaagactgtgacactgcactccagcctgggcaacagagtggactccatcgcaa

SEQ ID NO: 290906 - DNA, 2252 bp, Homo sapiens
gaccttatgaaactttttccccggcgtggtctcactcgcgatttaaggcataggtgtcgccgagccgggaggctgggagtcgccaggcgtgcgggggagaggcctgggccgcgccgcggcggggggtggaggaagagggcaggcgaggcgggaaggtgggctctggccgccgggagccggggacggagccgccgccgttgcccctagcggggagcagccgggaggagggggccgcagtcgggagaggggaccccaccatgcccaaagtcttcctggtgaagaggaggagcctgggggtctcggtccgcagctgggatgagctcccggatgagaaaagggcagacacctacatcccagtgggcctaggccgcctgctccacgacccccccgaggactgccgcagcgacggcggcagcagcagcggcagcggcagcagcagcgcgggggagcctggaggagcagagagcagctcgtccccgcacgcccccgagagcgaaacccccgagcccggcgacgccgagggccccgatggacacctggcgaccaagcagcgcccggtcgccagatcgaaaatcaagttcaccacaggcacgtgcagcgactcggtggttcacagctgtgacctgtgtggcaagggcttccgtctgcagcgcatgctgaaccgtcacctcaagtgccacaaccaggtgaaaagacacctgtgcaccttctgcggcaagggcttcaacgacaccttcgacctgaagaggcacgtccgcacacacacaggcattcgtccctacaaatgcaacgtctgcaataaagccttcacccagcgctgctctctggagtcccacctgaagaaaatccatggggtgcagcagcagtatgcctataagcagcggcgggacaagctctacgtctgcgaggattgcggctacacgggccccacccaggaggacctgtacctgcacgtgaacagtgcccatccgggcagctcgtttctcaaaaagacatctaaaaaactggcagcccttctgcagggcaagctgacatccgcacaccaggagaataccagcctgagtgaggaggaggagaggaagtgaggagaaggaaggggaggacagacgttcacactgccacgtatgtctacgtggatttttggttttcagcttcccccaccccactggctcttcttaattagaagtgaccagttcacctctgtgtccttttgaaacatcagcagtagggtccattccaagattgtcagttaccgttagtgacgtcaggccctgtaacctgtgtcctgtctggcgcagttgctcacattcaccaaagtttgttttcatgatcctgatggccaagaacaccgtgtgggatttttttttcccccaaggattttcacacacggaaggagaggtatttcttagagagatcatcattttatggtgccttgaaataaaaatacttctacttgaaatgctgtttaagcaaggcaagtgaattttgttattctgaaagagtttacagaaactattttaataaatgaaatgttcttgtgaagcttttaaaagcaaaatggaacattgacctacagctctctgttcagggcttattgtgtgatgtttaacttcaggttattgaggtggggaggttgattactttatattagttgtgtgggtttgaagaagcagatcttcctctctttttttgtttttgagacaagttctcactctgtcacccaggctggagtacagtggcatgatcatggctcactgcaaccttgacctcccaggctcaggtaatcttcccacttcagcctcccgagtagctgggactataggtgtgtgccactatgcccagctaatttttgtattttttgtagagatggggttttgctagaatgtgtgtattcttgctgtccactgtttcttcttcttttagcattttaattagcagatagcatattatacatactgtttggaactttgcatttttcttttttttaattttaaattttaagtgttgtgggtacatagtaggtgtatatgcatttttcttttaatagtacatctagtggttctttccaaaatagtacaaaaaagtgttctcatacaaaaaaattagccgggcatggtggtgtgtacctgtaatcccagctacttgggaggctgaggcaagagaatcgcttgaaactgggaggcaggggttggagtgagccaagactgtgacactgcactccagcctgggcaacagagtggactccatcgcaa

SEQ ID NO: 290907 - DNA, 1463 bp, Homo sapiens
gaccttatgaaactttttccccggcgtggtctcactcgcgatttaaggcataggtgtcgccgagccgggaggctgggagtcgccaggcgtgcgggggagaggcctgggccgcgccgcggcggggggtggaggaagagggcaggcgaggcgggaaggtgggctctggccgccgggagccggggacggagccgccgccgttgcccctagcggggagcagccgggaggagggggccgcagtcgggagaggggaccccaccatgcccaaagtcttcctggtgaagaggaggagcctgggggtctcggtccgcagctgggatgagctcccggatgagaaaagggcagacacctacatcccagtgggcctaggccgcctgctccacgacccccccgaggactgccgcagcgacggcggcagcagcagcggcagcggcagcagcagcgcgggggagcctggaggagcagagagcagctcgtccccgcacgcccccgagagcgaaacccccgagcccggcgacgccgagggccccgatggacacctggcgaccaagcagcgcccggtcgccagatcgaaaatcaagttcaccacaggcacgtgcagcgactcggtggttcacagctgtgacctgtgtggcaagggcttccgtctgcagcgcatgctgaaccgtcacctcaagtgccacaaccaggtgaaaagacacctgtgcaccttctgcggcaagggcttcaacgacaccttcgacctgaagaggcacgtccgcacacacacaggcattcgtccctacaaatgcaacgtctgcaataaagccttcacccagcgctgctctctggagtcccacctgaagaaaatccatggggtgcagcagcagtatgcctataagcagcggcgggacaagctctacgtctgcgaggattgcggctacacgggccccacccaggaggacctgtacctgcacgtgaacagtgcccatccgggcagctcgtttctcaaaaagacatctaaaaaactggcagcccttctgcagggcaagctgacatccgcacaccaggagaataccagcctgagtgaggaggaggagaggaagtgaggagaaggaaggggaggacagacgttcacactgccacgtatgtctacgtggatttttggttttcagcttcccccaccccactggctcttcttaattagaagtgaccagttcacctctgtgtccttttgaaacatcagcagtagggtccattccaagattgtcagttaccgttagtgacgtcaggccctgtaacctgtgtcctgtctggcgcagttgctcacattcaccaaagtttgttttcatgatcctgatggccaagaacaccgtgtgggatttttttttcccccaaggattttcacacacggaaggagaggtatttcttagagagatcatcattttatggtgccttgaaataaaaatacttctacttgaaatgct

SEQ ID NO: 290908 - DNA, 1267 bp, Homo sapiens
ctccagggcatccctgaccagacgcgcccccgcagcacccggcagctggcacacgtctgacgacctcctggaggagggcgaccgcagcgacacaagaggctgtgccggttgtcctgggcgcacccgaacaaggccttgggaagggcagcgcgccccgcaactgggcctaggccgcctgctccacgacccccccgaggactgccgcagcgacggcggcagcagcagcggcagcggcagcagcagcgcgggggagcctggaggagcagagagcagctcgtccccgcacgcccccgagagcgaaacccccgagcccggcgacgccgagggccccgatggacacctggcgaccaagcagcgcccggtcgccagatcgaaaatcaagttcaccacaggcacgtgcagcgactcggtggttcacagctgtgacctgtgtggcaagggcttccgtctgcagcgcatgctgaaccgtcacctcaagtgccacaaccaggtgaaaagacacctgtgcaccttctgcggcaagggcttcaacgacaccttcgacctgaagaggcacgtccgcacacacacaggcattcgtccctacaaatgcaacgtctgcaataaagccttcacccagcgctgctctctggagtcccacctgaagaaaatccatggggtgcagcagcagtatgcctataagcagcggcgggacaagctctacgtctgcgaggattgcggctacacgggccccacccaggaggacctgtacctgcacgtgaacagtgcccatccgggcagctcgtttctcaaaaagacatctaaaaaactggcagcccttctgcagggcaagctgacatccgcacaccaggagaataccagcctgagtgaggaggaggagaggaagtgaggagaaggaaggggaggacagacgttcacactgccacgtatgtctacgtggatttttggttttcagcttcccccaccccactggctcttcttaattagaagtgaccagttcacctctgtgtccttttgaaacatcagcagtagggtccattccaagattgtcagttaccgttagtgacgtcaggccctgtaacctgtgtcctgtctggcgcagttgctcacattcaccaaagtttgttttcatgatcctgatggccaagaacaccgtgtgggatttttttttcccccaaggattttcacacacggaaggagaggtatttcttagagagatcatcattttatggtgccttgaaataaaaatacttctacttgaaatgct

SEQ ID NO: 290909 - DNA, 554 bp, Homo sapiens
accaggcggttgtgtccccaagggccattcagggcggaagggaacagggaaaaccgctgtgttgattcccgggccctgtaggctgggagcgcggagggtcaggttacagacagttcaccacaggcacgtgcagcgactcggtggttcacagctgtgacctgtgtggcaagggcttccgtctgcagcgcatgctgaaccgtcacctcaagtgccacaaccaggtgaaaagacacctgtgcaccttctgcggcaagggcttcaacgacaccttcgacctgaagaggcacgtccgcacacacacagaagtcctcgcagagaatggctgaggctgattgggacgcattaactggggctctggtgagccgactgagctgagtcccctgcagtgcctgtatgacctgcaccaacgtgggaattgccatctctcctgctggaaaatcagtgctgcctgtgggaagcccgccctggttggagctgcagtttcctaccagtttgctgagatctgtatctgtggacctgaatgttgatccctcgcttcagattgacatacctga

SEQ ID NO: 290910 - DNA, 984 bp, Homo sapiens
aacagttcccagacatgagtgatagcatttgaaggaaaacacagaaagcaggaagaaaagggatactggaaaaatgcttggaatggattcttgatgaagttcaccacaggcacgtgcagcgactcggtggttcacagctgtgacctgtgtggcaagggcttccgtctgcagcgcatgctgaaccgtcacctcaagtgccacaaccaggtgaaaagacacctgtgcaccttctgcggcaagggcttcaacgacaccttcgacctgaagaggcacgtccgcacacacacaggcattcgtccctacaaatgcaacgtctgcaataaagccttcacccagcgctgctctctggagtcccacctgaagaaaatccatggggtgcagcagcagtatgcctataagcagcggcgggacaagctctacgtctgcgaggattgcggctacacgggccccacccaggaggacctgtacctgcacgtgaacagtgcccatccgggcagctcgtttctcaaaaagacatctaaaaaactggcagcccttctgcagggcaagctgacatccgcacaccaggagaataccagcctgagtgaggaggaggagaggaagtgaggagaaggaaggggaggacagacgttcacactgccacgtatgtctacgtggatttttggttttcagcttcccccaccccactggctcttcttaattagaagtgaccagttcacctctgtgtccttttgaaacatcagcagtagggtccattccaagattgtcagttaccgttagtgacgtcaggccctgtaacctgtgtcctgtctggcgcagttgctcacattcaccaaagtttgttttcatgatcctgatggccaagaacaccgtgtgggatttttttttcccccaaggattttcacacacggaaggagaggtatttcttagagagatcatcattttatggtgccttgaaataaaaatacttctacttgaaatgct

SEQ ID NO: 290911 - DNA, 2473 bp, Homo sapiens
ggcgacgggtcggcggagacagaaaagcgccggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcccccctcgtgtcaatatttgttatagactaatcgccggggatttttcacctggttggagggtgggggtgggtgtgtgtgtgtgtgtgtgtgtgtgtgtgtgtgtgtgtgtgtgtgtgtgtgtgtttgtaggtcctggactgattaaagttcattgaggaaaaagcacattttacaacaaaaaaataaaagtgtagatttaatgtatgtgactggggtttggggttgcatacctggtggatcttgaggggctgggattagggtggttcaggaaaatgtgatgctgtttccccatgtttagccatggtcaaaaaatggatttctcctttttctaaaatgtccagcaactgcctactgttgatcaaatgttgaagtattcttgtttcccttttaagccaatccatgtgcccacataacattatgcccaagtggagagttcactttaatttccaaagtatgtttcatgcagccccctgtcagctgctctgtggaaaaggggttctgttatgaaataaatgttgcactccctgcatcccat

SEQ ID NO: 290912 - DNA, 459 bp, Homo sapiens
gatttttgtggtgggtgggactgagcagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcagaatggtaaccctcgtgccg

SEQ ID NO: 290913 - DNA, 518 bp, Homo sapiens
ctccccgggaagtcccataggacacaatattcatctggtgttgttgcctagagtttgtcccagcggagggttggcttcggatctgcagaggctttagggacctgctccagccactgagcacactagccgtctgagacggcagctgagttgcactgtgcgacgcgacagagactacatttcccagcattccagcggcgcactcgggggaccacagatcccagcgcaccacaaagaggcccggggactacaaatcccagcatcccctgcactcggttcctctgtaacttagactccagtgtgccgcgcagtgtgcgcaaattcacaaacccgcccgctgagttggtcgtttcggaatcccgagacttgaaacccaacgggaagacccttctcaccctcaaaagaagatgacagcccgcagagagttaacttctgtttacatggaactcagacatctgcaaatcatggtaaggctgcaaacaacaaacaaaaacactgattaaaccgtgaaagagaacaaa

SEQ ID NO: 290914 - DNA, 396 bp, Homo sapiens
  misc_feature (353)..(353): n is a, c, g, or t
  misc_feature (359)..(359): n is a, c, g, or t
ggctgaagttcatcctctactggtttattcaagaaggttcatggagctgtattcccaaagtttttatgaaaatatttgtggttttataaatgaataacagcagagtgtagaattcttgggtccctctttctgaggacattttaatcacgatttatttcactgttggtgatgtgcctctttgccaaatgttccccttccatttgtttcaaccaggagagcattagtcccacatttttgcttgactcatttccacaaatctgctgtgagtagcccaggctcgtttctgctcatctggatttctgaagagaatttcaggttttcttgcagaggattttagcttcctgcctaacttnccatgngttatgatatatactctgacagtgatttacaattacc

SEQ ID NO: 290915 - DNA, 2549 bp, Homo sapiens
ggcgacgggtcggcggagacagaaaagcgccggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcccccctcgtgtcaatatttgttatagactaatcgccggggatttttcacctggttggagggtgggggtgggtgtgtgtgtgtgtgtgtgtgtgtgtgtgtgtgtgtgtgtgtgtgtgtgtgtgtttgtaggtcctggactgattaaagttcattgaggaaaaagcacattttacaacaaaaaaataaaagtgtagatttaatgtatgtgactggggtttggggttgcatacctggtggatcttgaggggctgggattagggtggttcaggaaaatgtgatgctgtttccccatgtttagccatggtcaaaaaatggatttctcctttttctaaaatgtccagcaactgcctactgttgatcaaatgttgaagtattcttgtttcccttttaagccaatccatgtgcccacataacattatgcccaagtggagagttcactttaatttccaaagtatgtttcatgcagccccctgtcagctgctctgtggaaaaggggttctgttatgaaataaatgttgcactccctgcatcccat

SEQ ID NO: 290916 - DNA, 2471 bp, Homo sapiens
ggcgacgggtcggcggagacagaaaagcgccggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcccccctcgtgtcaatatttgttatagactaatcgccggggatttttcacctggttggagggtgggggtgggtgtgtgtgtgtgtgtgtgtgtgtgtgtgtgtgtgtgtgtgtgtgtgtgtgtgtttgtaggtcctggactgattaaagttcattgaggaaaaagcacattttacaacaaaaaaataaaagtgtagatttaatgtatgtgactggggtttggggttgcatacctggtggatcttgaggggctgggattagggtggttcaggaaaatgtgatgctgtttccccatgtttagccatggtcaaaaaatggatttctcctttttctaaaatgtccagcaactgcctactgttgatcaaatgttgaagtattcttgtttcccttttaagccaatccatgtgcccacataacattatgcccaagtggagagttcactttaatttccaaagtatgtttcatgcagccccctgtcagctgctctgtggaaaaggggttctgttatgaaataaatgttgcactccctgcatcccat

SEQ ID NO: 290917 - DNA, 1751 bp, Homo sapiens
ggcgacgggtcggcggagacagaaaagcgccggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcccccctcgtgtcaatatttgttatagactaatcgccggggatttttcacctggttggagggtgggggtgggtgtgtgtgtgtgtgtgtgtgtgtgtgtgtgtgtgtgtgtgtgtgtgtgtgtgtttgtaggtcctggactgattaaagttcattgaggaaaaagcacattttacaacaaaaaaataaaagtgtagatttaatgtatgtgactggggtttggggttgcatacctggtggatcttgaggggctgggattagggtggttcaggaaaatgtgatgctgtttccccatgtttagccatggtcaaaaaatggatttctcctttttctaaaatgtccagcaactgcctactgttgatcaaatgttgaagtattcttgtttcccttttaagccaatccatgtgcccacataacattatgcccaagtggagagttcactttaatttccaaagtatgtttcatgcagccccctgtcagctgctctgtggaaaaggggttctgttatgaaataaatgttgcactccctgcatcccat

SEQ ID NO: 290918 - DNA, 1266 bp, Homo sapiens
ggcgacgggtcggcggagacagaaaagcgccggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgtctacgaggggtatgccctcccccatgccatcctccatggtctgagctcatcccaccttgcctttccacagagcatcatcc

SEQ ID NO: 290919 - DNA, 1661 bp, Homo sapiens
ggctgaagttcatcctctactggtttattcaagaaggttcatggagctgtattcccaaagtttttatgaaaatatttgtggttttataaatgaataacagcagagtgtagaattcttgggtccctctttctgaggacattttaatcacgatttatttcactgttggtgatgtgcctctttgccaaatgttccccttccatttgtttcaaccaggagagcattagtcccacatttttgcttgactcatttccacaaatctgctgtgagtagcccaggctcgtttctgctcatctggatttctgaagagaatttcaggttttcttgcagaggattttagcttcctgtctgaagtgaagacatagtgagagcaagttttggtgagcacatacaggctgagcactccaattctatatctccccaccaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcc

SEQ ID NO: 290920 - DNA, 1398 bp, Homo sapiens
ggctgaagttcatcctctactggtttattcaagaaggttcatggagctgtattcccaaagtttttatgaaaatatttgtggttttataaatgaataacagcagagtgtagaattcttgggtccctctttctgaggacattttaatcacgatttatttcactgttggtgatgtgcctctttgccaaatgttccccttccatttgtttcaaccaggagagcattagtcccacatttttgcttgactcatttccacaaatctgctgtgagtagcccaggctcgtttctgctcatctggatttctgaagagaatttcaggttttcttgcagaggattttagcttcctgtctgaagtgaagacatagtgagagcaagttttggtgagcacatacaggctgagcactccaattctatatctccccaccaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcccccctcgtgtcaatatttgttatagactaatcgccggggatttttcacctggttggagggtgggggtgggtgtgtgtgtgtgtgtgtgtgtgtgtgtgtgtgtgtgtgtgtgtgtgtgtgtgtttgtaggtcctggactgattaaagttcattgaggaaaaagcacattttacaacaaaaaaataaaagtgtagatttaatgtatgtgactggggtttggggttgcatacctggtggatcttgaggggctgggattagggtggttcaggaaaatgtgatgctgtttccccatgtttagccatggtcaaaaaatggatttctcctttttctaaaatgtccagcaactgcctactgttgatcaaatgttgaagtattcttgtttcccttttaagccaatccatgtgcccacataacattatgcccaagtggagagttcactttaatttccaaagtatgtttcatgcagccccctgtcagctgctctgtggaaaaggggttctgttatgaaataaatgttgcactccctgcatcccat

SEQ ID NO: 290921 - DNA, 891 bp, Homo sapiens
tgacaaaagcatgttgaaatgtattagaatcagaacctgtccaaaaaaaaaaaaattaaaatataacctgaaactgttcaagttcagaagtctagttaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcccccctcgtgtcaatatttgttatagactaatcgccggggatttttcacctggttggagggtgggggtgggtgtgtgtgtgtgtgtgtgtgtgtgtgtgtgtgtgtgtgtgtgtgtgtgtgtgtttgtaggtcctggactgattaaagttcattgaggaaaaagcacattttacaacaaaaaaataaaagtgtagatttaatgtatgtgactggggtttggggttgcatacctggtggatcttgaggggctgggattagggtggttcaggaaaatgtgatgctgtttccccatgtttagccatggtcaaaaaatggatttctcctttttctaaaatgtccagcaactgcctactgttgatcaaatgttgaagtattcttgtttcccttttaagccaatccatgtgcccacataacattatgcccaagtggagagttcactttaatttccaaagtatgtttcatgcagccccctgtcagctgctctgtggaaaaggggttctgttatgaaataaatgttgcactccctgcatcccat

SEQ ID NO: 290922 - DNA, 817 bp, Homo sapiens
gcctggtaccacagtcctcacgatggtaccagggctggagaggagtgccccctcctcacaaggggaggggcctccttcacaatcatccctgggggctggttaaagctgcctccggcttataaccagcctgacaaaatgacgtggagcaaaagaaaaactgggagggagacaaggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcc

SEQ ID NO: 290923 - DNA, 2014 bp, Homo sapiens
ggcgacgggtcggcggagacagaaaagcgccggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcc

SEQ ID NO: 290924 - DNA, 2353 bp, Homo sapiens
ctccccgggaagtcccataggacacaatattcatctggtgttgttgcctagagtttgtcccagcggagggttggcttcggatctgcagaggctttagggacctgctccagccactgagcacactagccgtctgagacggcagctgagttgcactgtgcgacgcgacagagactacatttcccagcattccagcggcgcactcgggggaccacagatcccagcgcaccacaaagaggcccggggactacaaatcccagcatcccctgcactcggttcctctgtaacttagactccagtgtgccgcgcagtgtgcgcaaattcacaaacccgcccgctgagttggtcgtttcggaatcccgagacttgaaacccaacgggaagacccttctcaccctcaaaagaagatgacagcccgcagagagttaacttctgtttacatggaactcagacatctgcaaatcatgatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcc

SEQ ID NO: 290925 - DNA, 1663 bp, Homo sapiens
gatttttgtggtgggtgggactgagcagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcc

SEQ ID NO: 290926 - DNA, 2188 bp, Homo sapiens
ctccccgggaagtcccataggacacaatattcatctggtgttgttgcctagagtttgtcccagcggagggttggcttcggatctgcagaggctttagggacctgctccagccactgagcacactagccgtctgagacggcagctgagttgcactgtgcgacgcgacagagactacatttcccagcattccagcggcgcactcgggggaccacagatcccagcgcaccacaaagaggcccggggactacaaatcccagcatcccctgcactcggttcctctgtaacttagactccagtgtgccgcgcagtgtgcgcaaattcacaaacccgcccgctgagttggtcgtttcggaatcccgagacttgaaacccaacgggaagacccttctcaccctcaaaagaagatgacagcccgcagagagttaacttctgtttacatggaactcagacatctgcaaatcatgatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcc

SEQ ID NO: 290927 - DNA, 554 bp, Homo sapiens
gtggcctgggtgctggacttttcatattaagtcctgtcttagccaagggagaagaatgtaaggataagaccaccaatatcacaggggctgtctgagcctttacctgtgattttctaccactctgtggccttctggagcaatggacaaccaagtcagctatgcagttcataaaagtggacctggttatatgtcatccaacagcatatggtccctgcaagcctgtttggaagccaatattctataacctacaggaatccactgaatctgatgtctttggaagcaatatattttccagggttccaatggactacggaataaggcaacacagggcctgttttcccgcagtgtcctctgctccaaggaactttcttaaggaagcgggacgtgtcaatgaggtacctcccggggttctacagttcctcctgcccactggccagggggaatctggcgggagcctctcggtggatgctgtcacatgactgtgccttctgaaagaacatctgtgaagagcagtttctggtgtccctgagtaacccttttctaacaattcagcc

SEQ ID NO: 290928 - DNA, 572 bp, Homo sapiens
cagctataatgaatacacccagtgtccagtttcggtttatcttattttattttattttttttgagacagagttttgctctcgttgcccaggctgggatgcaatggcgcaatcttgactcactgcaacctccctctgcccccagccccccagattcaagcaattctcctgcctcagcctcccaagtagctgagattacagccgtgagccaccgtgcgcagccccatcctgctgatttgttccttccagactgttcgttccttcttcttccagtcagtaggtgtcttgggtgggggcacatttccgttgtcttgctctggcaaacctttcatttgtctgctcattcattcatttattcaacaaactttttaaagtacctactaagtgctaaaagaatacagaattgaatgtaccatggccactgcctgtaaggcactcatggtccagcgagccctcccctcagagtctccctctcactagtggaacttctctagcagaagctcttactccactgctgtatgccctttgtattctctgttttctgtctcacatcgttgcttttctggcccttcat

SEQ ID NO: 290929 - DNA, 779 bp, Homo sapiens
agaccgagagtcggtggaaggactgggtgagctcatcgcgggcgtagctgagcgaattgggcacgtggttgtggccagagcaccgacccttcttggggctcttgcattcttcattccagtcggttttcacatcacggacagcccgtgaatactcatcgatgtcgaactgttcttggcagatacctagccagtgatggaccagggtttcgggccagctctctcccttcaccaggtgttctgggaggctgaacttggggacagtcaagtgcaaaggaaagtgcatggggaggatcttgttgttccgcagcacacagcaaaccaccaccgtcttggtctggatgttcacaaacttatagcggtgcccctcacggatgaagtggaggtcgtatgggtttctcggtggagggcttggcacagtcacattcacaggaagcctggttttctccacaatgttgcggatggtgtgttcgccctcttgcatctgaagttccaggggacttcgggtgctaaatctgcccttgcactggaatggaaggctaatgctttcgttggtccggtgattcatacaaatgaggcacggcattttgccttttcccagcttgctgatggaattgagcttcccaatctttttgaagattgtgttgagtcgtgacttttccttgaatgtctttgcataaaggatttctgcctgccccattagaatctgataacaaaagccctgacttgtgtttattctgactcaaaaagtatgtggatggcagaaaacaagagaaataaag

SEQ ID NO: 290930 - DNA, 1214 bp, Homo sapiens
aggcccggggcagttaacccttctcttgctgcggcagagtccgcacccgggcaggcccatctcagaattaacgctttgatggcatcaccgcgtcgggaatccctggggatggtgttctccaccgtcaagacctttgagccgcctgagcgactaactcctgcgcccctgaggtcacagctacttggaaggctgagatgtgaagactacttgagctcagaagttccactgcactccagcctgggttacagagggaaaccttgtctctaaaaaaaagaaaaaagaaagaaagaaaaagaaaacataggacattttattcagaaattaaatcattcagagttccagcactgtcgggggtcatcgggctctgtccaccgccataggcctagcattgtcaccaacggagccatagagggacctcggcccaagctggggcctcttcattgtcgaagaaggcctcttgccagaccaggatctgtgggcgcggccaggctggaggactagggcggtggcagtggccaggtgagtgcacatggctgtgggtggtccctcaattgctccctcctctctttcgctaccccctgggctggagggaggcagggcacccagccggaatggcatgatcctgaagcccaacttccacaaggactggcagtggtgtggccatgtggctcagccagcccatggggcagacctgcagaagcaaggtggccagcaaaagcaggctgcatggcccactgatatgggcccatccacccatagtaaggtgccccatgctgaggcatcactacaaagcacaagctggcaggggcctcagcttggaggagttaagggtggctggcatttacaagaaggtggcccagaccattggcatctctgaggatgcaaggaggaggaaccagtccacccaggccctgcaggccaaggtgcagaggctgaaggaggaccgctcctcactcatcctcttccccaggaagcccttggcccccaagaagggagacagttctgctgaagaactcgaactggatactcagctgacaggaccagaaatgcccatcggcaatgtctacaaggagaaagccagagtcatcgctgactaggaggaaaacttccaggccttgttagtctctgtatggcccatgcaaatgcccagctcttcggcatataggcacaaagagccaaggaagctgtagaagaggacgcttaaaaaaaaaaaa

SEQ ID NO: 290931 - DNA, 763 bp, Homo sapiens
aggcccggggcagttaacccttctcttgctgcggcagagtccgcacccgggcaggcccatctcagaattaacgctttgatggcatcaccgcgtcgggaatccctggggatggtgttctccaccgtcaagacctttgagccgcctgagcgactaactcctgcgcccctgaggtcacagctacttggaaggctgagatgtgaagactacttgagctcagaagttccactgcactccagcctgggttacagagggaaaccttgtctctaaaaaaaagaaaaaagaaagaaagaaaaagaaaacataggacattttattcagaaattaaatcattcagagttccagcactgtcgggggtcatcgggctctgtccaccgccataggcctagcattgtcaccaacggagccatagagggacctcggcccaagctggggcctcttcattgtcgaagaaggcctcttgccagaccaggatctgtgggcgcggccaggctggaggactagggcggtggcagtggccaggaagcccttggcccccaagaagggagacagttctgctgaagaactcgaactggatactcagctgacaggaccagaaatgcccatcggcaatgtctacaaggagaaagccagagtcatcgctgactaggaggaaaacttccaggccttgttagtctctgtatggcccatgcaaatgcccagctcttcggcatataggcacaaagagccaaggaagctgtagaagaggacgcttaaaaaaaaaaaa

SEQ ID NO: 290932 - DNA, 1109 bp, Homo sapiens
  misc_feature (88)..(88): n is a, c, g, or t
  misc_feature (636)..(636): n is a, c, g, or t
gcagaaggcaagcccggaggcactttcaagaatgagcatatctcatcttcccggagaaaaaaaaaaaagaatggtacgtctgagaatnaaattttgaaagagtgcaatgatgggtcgtttgataatttgtcggaaaaacaatctacctgttatctagctttgggctaggccattccagttccagacgcaggctgaacgtcgtgaagcggaaggggcgggcccgcaggcgtccgtgtggtcctccgtgcagccctcggcccgagccggttcttcctggtaggaggcggaactcgaattcatttctcccgctgccccatctcttagctcgcggttgtttcattccgcagtttcttcccatgcacctgccgcgtaccggccactttgtgccgtacttacgtcatctttttcctaaatcgaggtggcatttacacacagcgccagtgcacacagcaagtgcacaggaagatgagttttggcccctaaccgctccgtgatgcctaccaagtcacagacccttttcatcgtcccagaaacgtttcatcacgtctcttcccagtcgattcccgaccccacctttattttgatctccataaccattttgcctgttggagaacttcatatagaatggaatcaggntgggcgctgtggctcacgcctgcactttgggaggccgaggcgggcggattacttgaggataggagttccagaccagcgtggccaacgtggtgaatccccgtctctactaaaaaatacaaaaattagctgggcgtggtgggtgcctgtaatcccagctattcgggagggtgaggcaggagaatcgcttgaacccgggaggcagaggttgcagtgagccaagatcgtgccactacactccagcctgggcgacaagaacgaaactccgtctcaaaaaaaaggggggaatcatacattatgtgctcatttttgtcgggcttctgtccttcaatgtactgtctgacattcgttcatgttgtatatatcagtattttgctccttttcatttagtatagtccatcgattgtatatccgtccttttgatggccttttgagttgtttcccatttgcggttatgaaataaagctgctataaac

SEQ ID NO: 290933 - DNA, 132 bp, Homo sapiens
gctcgacgaggaccctctgcaatttggcctgagactccagggtcctgaagagcactggactaagagtctagtggttccagggccctgaccagtaggtgctcaataaatgtttgttgttgaatgaaaaaaaaa

SEQ ID NO: 290934 - DNA, 3369 bp, Homo sapiens
aactggctccccctcttcctgtcctctttccctacccccgccctggctggtccacgtggaatgggggctgggaagactgagctggcctggccgggaggagcgggggagggggttgcaataggaggagggggccaggctgagtgtgttagagtctgagggaggcactacaaagaactctaggttccccctccccccatctccatccctggctgcgagacctggggcctggccagggagagaggctcgggaaagatgagaactctgagtggacaccaaaggaaaaaaaaaaaaaaaagttcaatgactttttccggagcccccgggtcctaaagccgggcggagatgaaccttgcttctttcgcgggcacttcgaattctagtcccctccaggtgggtggtgaagccgcggagtgtgagaggcatctccgtgctcatccgtgaccccagctgtactccaagggaaggcatctccagggaagagcagcttggtcccgcaaaagctggactgaaagaaggactttgtgacttgggatgtgacgggcacggagatggagtggggggtggtggcagcgcaaggtgtgcaggtgacagcaggtgtgtgcctccgacgtgggcgggggagacactcggagggtgcaggagggcgcagcgacggaaggcccggctccagggcttccttctcgtatgggcagcgcagaggaggcggccctcactcagtgtcctgatctcaggcgggggcactgtttgcatggggaggggcttcctgggcttcccatctctggcgggaagcgctccccgacgcattctctacctaggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagatctctttgcagagtccctgcagtgcaaggtggactgtgaggccaatttgacccccaatgtgggtggctacttcgtggacaagttcgtggccaccatgtaccactacctgcagtttgcctactataagttgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggaggaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacacccctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacgaggagtttccagctgctggctggagtctcaggccaaattgcagagggtcctccagggtcctgaagagcactggactaagagtctagtggttccagggccctgaccagtaggtgctcaataaatgtttgttgttgaatgaaaaaaaaa

SEQ ID NO: 290935 - DNA, 2390 bp, Homo sapiens
gctagtaggccggtggttatcggccgaggagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagatctctttgcagagtccctgcagtgcaaggtggactgtgaggccaatttgacccccaatgtgggtggctacttcgtggacaagttcgtggccaccatgtaccactacctgcagtttgcctactataagttgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggaggaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacacccctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacgaggagtttccagctgctggctggagtctcaggccaaattgcagagggtcctccagggtcctgaagagcactggactaagagtctagtggttccagggccctgaccagtaggtgctcaataaatgtttgttgttgaatgaaaaaaaaa

SEQ ID NO: 290936 - DNA, 3359 bp, Homo sapiens
aactggctccccctcttcctgtcctctttccctacccccgccctggctggtccacgtggaatgggggctgggaagactgagctggcctggccgggaggagcgggggagggggttgcaataggaggagggggccaggctgagtgtgttagagtctgagggaggcactacaaagaactctaggttccccctccccccatctccatccctggctgcgagacctggggcctggccagggagagaggctcgggaaagatgagaactctgagtggacaccaaaggaaaaaaaaaaaaaaaagttcaatgactttttccggagcccccgggtcctaaagccgggcggagatgaaccttgcttctttcgcgggcacttcgaattctagtcccctccaggtgggtggtgaagccgcggagtgtgagaggcatctccgtgctcatccgtgaccccagctgtactccaagggaaggcatctccagggaagagcagcttggtcccgcaaaagctggactgaaagaaggactttgtgacttgggatgtgacgggcacggagatggagtggggggtggtggcagcgcaaggtgtgcaggtgacagcaggtgtgtgcctccgacgtgggcgggggagacactcggagggtgcaggagggcgcagcgacggaaggcccggctccagggcttccttctcgtatgggcagcgcagaggaggcggccctcactcagtgtcctgatctcaggcgggggcactgtttgcatggggaggggcttcctgggcttcccatctctggcgggaagcgctccccgacgcattctctacctaggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagatctctttgcagagtccctgcagtgcaaggtggactgtgaggccaatttgacccccaatgtgggtggctacttcgtggacaagttcgtggccaccatgtaccactacctgcagtttgcctactataagttgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggaggaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacacccctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacgaggagtttccagctgctggctggagtctcagccccacttccaatggtctctcatgattctctatacctaatggtttatacttaatgggcttcaggggcctgaaaggtccgttatcaccagaaaggtgattgtgagca

SEQ ID NO: 290937 - DNA, 2928 bp, Homo sapiens
aactggctccccctcttcctgtcctctttccctacccccgccctggctggtccacgtggaatgggggctgggaagactgagctggcctggccgggaggagcgggggagggggttgcaataggaggagggggccaggctgagtgtgttagagtctgagggaggcactacaaagaactctaggttccccctccccccatctccatccctggctgcgagacctggggcctggccagggagagaggctcgggaaagatgagaactctgagtggacaccaaaggaaaaaaaaaaaaaaaagttcaatgactttttccggagcccccgggtcctaaagccgggcggagatgaaccttgcttctttcgcgggcacttcgaattctagtcccctccaggtgggtggtgaagccgcggagtgtgagaggcatctccgtgctcatccgtgaccccagctgtactccaagggaaggcatctccagggaagagcagcttggtcccgcaaaagctggactgaaagaaggactttgtgacttgggatgtgacgggcacggagatggagtggggggtggtggcagcgcaaggtgtgcaggtgacagcaggtgtgtgcctccgacgtgggcgggggagacactcggagggtgcaggagggcgcagcgacggaaggcccggctccagggcttccttctcgtatgggcagcgcagaggaggcggccctcactcagtgtcctgatctcaggcgggggcactgtttgcatggggaggggcttcctgggcttcccatctctggcgggaagcgctccccgacgcattctctacctaggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagatctctttgcagagtccctgcagtgcaaggtggactgtgaggccaatttgacccccaatgtgggtggctacttcgtggacaagttcgtggccaccatgtaccactacctgcagtttgcctactataagtcgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacgaggagtttccagctgctggctggagtctcaggccaaattgcagagggtcctccagggtcctgaagagcactggactaagagtctagtggttccagggccctgaccagtaggtgctcaataaatgtttgttgttgaatgaaaaaaaaa

SEQ ID NO: 290938 - DNA, 3374 bp, Homo sapiens
aactggctccccctcttcctgtcctctttccctacccccgccctggctggtccacgtggaatgggggctgggaagactgagctggcctggccgggaggagcgggggagggggttgcaataggaggagggggccaggctgagtgtgttagagtctgagggaggcactacaaagaactctaggttccccctccccccatctccatccctggctgcgagacctggggcctggccagggagagaggctcgggaaagatgagaactctgagtggacaccaaaggaaaaaaaaaaaaaaaagttcaatgactttttccggagcccccgggtcctaaagccgggcggagatgaaccttgcttctttcgcgggcacttcgaattctagtcccctccaggtgggtggtgaagccgcggagtgtgagaggcatctccgtgctcatccgtgaccccagctgtactccaagggaaggcatctccagggaagagcagcttggtcccgcaaaagctggactgaaagaaggactttgtgacttgggatgtgacgggcacggagatggagtggggggtggtggcagcgcaaggtgtgcaggtgacagcaggtgtgtgcctccgacgtgggcgggggagacactcggagggtgcaggagggcgcagcgacggaaggcccggctccagggcttccttctcgtatgggcagcgcagaggaggcggccctcactcagtgtcctgatctcaggcgggggcactgtttgcatggggaggggcttcctgggcttcccatctctggcgggaagcgctccccgacgcattctctacctaggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggtggggtggagggtcaggaggaggcttgtagaggagggctagtagaggaggggagatgttgggggcgccctgactccccctgccacgccccttccaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcaggtatctgccacccagaccacggtgggcggtcctctcacccacagggcccggtaaggcagatgtccccttcatgcacgtggagcactgcgaatgcggaggagccagccgggaggaaggccttgtctgttgagaaagacgctgggtgcaggggccccagctgggagtgtccaaggggctggatcagaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacacccctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacgaggagtttccagctgctggctggagtctcaggccaaattgcagagggtcctccagggtcctgaagagcactggactaagagtctagtggttccagggccctgaccagtaggtgctcaataaatgtttgttgttgaatgaaaaaaaaa

SEQ ID NO: 290939 - DNA, 2428 bp, Homo sapiens
aactggctccccctcttcctgtcctctttccctacccccgccctggctggtccacgtggaatgggggctgggaagactgagctggcctggccgggaggagcgggggagggggttgcaataggaggagggggccaggctgagtgtgttagagtctgagggaggcactacaaagaactctaggttccccctccccccatctccatccctggctgcgagacctggggcctggccagggagagaggctcgggaaagatgagaactctgagtggacaccaaaggaaaaaaaaaaaaaaaagttcaatgactttttccggagcccccgggtcctaaagccgggcggagatgaaccttgcttctttcgcgggcacttcgaattctagtcccctccaggtgggtggtgaagccgcggagtgtgagaggcatctccgtgctcatccgtgaccccagctgtactccaagggaaggcatctccagggaagagcagcttggtcccgcaaaagctggactgaaagaaggactttgtgacttgggatgtgacgggcacggagatggagtggggggtggtggcagcgcaaggtgtgcaggtgacagcaggtgtgtgcctccgacgtgggcgggggagacactcggagggtgcaggagggcgcagcgacggaaggcccggctccagggcttccttctcgtatgggcagcgcagaggaggcggccctcactcagtgtcctgatctcaggcgggggcactgtttgcatggggaggggcttcctgggcttcccatctctggcgggaagcgctccccgacgcattctctacctaggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggtggggtggagggtcaggaggaggcttgtagaggagggctagtagaggaggggagatgttgggggcgccctgactccccctgccacgccccttccaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcaggtatctgccacccagaccacggtgggcggtcctctcacccacagggcccggtaaggcagatgtccccttcatgcacgtggagcactgcgaatgcggaggagccagccgggaggaaggccttgtctgttgagaaagacgctgggtgcaggggccccagctgggagtgtccaaggggctggatcagaggccatgctctaccacaaccagaccgccgagctgcgggagctgctggagttcacccacatgtacctgcagtcagatgatgagagccagagcctgaactcgcatgagaaggggacaccccacacccctcaagcttgggaagcctggtgccgatggccccaccctcaccagcctgggcagcagcaagaactatttattaaaaacttaagatgggcagtggggggtcaactgtgatccagattgggaggcaggggggtactggggggacggggtagacagtgggaatgtgaaatcggtttaaaaataatacggggggggg

SEQ ID NO: 290940 - DNA, 355 bp, Homo sapiens
cggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaagaggtgggagcccgcccccacccggggacctgtctcgggctgggcgtcgtggctccccacagatcggtcgaaggagcgttatcttcacccaaggcacgaagcccgccgtgcgctcggggccgcgagctccggtcttgctgacccgctcccccaccccctaccccccgaccag

SEQ ID NO: 290941 - DNA, 419 bp, Homo sapiens
agcgggccttgtcagagtacctggcagtctttgcccggtgcctggccggctgtgaaggggcccatgagcaggtggacttcaaggacttctacccggccatagcaggtatctgccacccagaccacggtgggcggtcctctcacccacagggcccggtaaggcagatgtccccttcatgcacgtggagcactgcgaatgcggaggagccagccgggaggaaggccttgtctgttgagaaagacgctgggtgcaggggccccagctgggagtgtccaaggggctggatcagtgagtagaggcagtgacatccctaaagggtttgggaagcttgggttcataggccttccaggcagagggcagtgcagatgcaaaggtgcagcggtgagaagtaacccagcagatgtgtgcagaaagcagtt

SEQ ID NO: 290942 - DNA, 2930 bp, Homo sapiens
aactggctccccctcttcctgtcctctttccctacccccgccctggctggtccacgtggaatgggggctgggaagactgagctggcctggccgggaggagcgggggagggggttgcaataggaggagggggccaggctgagtgtgttagagtctgagggaggcactacaaagaactctaggttccccctccccccatctccatccctggctgcgagacctggggcctggccagggagagaggctcgggaaagatgagaactctgagtggacaccaaaggaaaaaaaaaaaaaaaagttcaatgactttttccggagcccccgggtcctaaagccgggcggagatgaaccttgcttctttcgcgggcacttcgaattctagtcccctccaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagatctctttgcagagtccctgcagtgcaaggtggactgtgaggccaatttgacccccaatgtgggtggctacttcgtggacaagttcgtggccaccatgtaccactacctgcagtttgcctactataagttgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggaggaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacacccctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacgaggagtttccagctgctggctggagtctcaggccaaattgcagagggtcctccagggtcctgaagagcactggactaagagtctagtggttccagggccctgaccagtaggtgctcaataaatgtttgttgttgaatgaaaaaaaaa

SEQ ID NO: 290943 - DNA, 2402 bp, Homo sapiens
aaataggctaggtcggaggctgggtggttaatcggccgaggagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagatctctttgcagagtccctgcagtgcaaggtggactgtgaggccaatttgacccccaatgtgggtggctacttcgtggacaagttcgtggccaccatgtaccactacctgcagtttgcctactataagttgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggaggaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacacccctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacgaggagtttccagctgctggctggagtctcaggccaaattgcagagggtcctccagggtcctgaagagcactggactaagagtctagtggttccagggccctgaccagtaggtgctcaataaatgtttgttgttgaatgaaaaaaaaa

SEQ ID NO: 290944 - DNA, 3277 bp, Homo sapiens
aactggctccccctcttcctgtcctctttccctacccccgccctggctggtccacgtggaatgggggctgggaagactgagctggcctggccgggaggagcgggggagggggttgcaataggaggagggggccaggctgagtgtgttagagtctgagggaggcactacaaagaactctaggttccccctccccccatctccatccctggctgcgagacctggggcctggccagggagagaggctcgggaaagatgagaactctgagtggacaccaaaggaaaaaaaaaaaaaaaagttcaatgactttttccggagcccccgggtcctaaagccgggcggagatgaaccttgcttctttcgcgggcacttcgaattctagtcccctccaggtgggtggtgaagccgcggagtgtgagaggcatctccgtgctcatccgtgaccccagctgtactccaagggaaggcatctccagggaagagcagcttggtcccgcaaaagctggactgaaagaaggactttgtgacttgggatgtgacgggcacggagatggagtggggggtggtggcagcgcaaggtgtgcaggtgacagcaggtgtgtgcctccgacgtgggcgggggagacactcggagggtgcaggagggcgcagcgacggaaggcccggctccagggcttccttctcgtatgggcagcgcagaggaggcggccctcactcagtgtcctgatctcaggcgggggcactgtttgcatggggaggggcttcctgggcttcccatctctggcgggaagcgctccccgacgcattctctacctaggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcaggtatctgccacccagaccacggtgggcggtcctctcacccacagggcccggtaaggcagatgtccccttcatgcacgtggagcactgcgaatgcggaggagccagccgggaggaaggccttgtctgttgagaaagacgctgggtgcaggggccccagctgggagtgtccaaggggctggatcagaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacacccctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacgaggagtttccagctgctggctggagtctcaggccaaattgcagagggtcctccagggtcctgaagagcactggactaagagtctagtggttccagggccctgaccagtaggtgctcaataaatgtttgttgttgaatgaaaaaaaaa

SEQ ID NO: 290945 - DNA, 2963 bp, Homo sapiens
aactggctccccctcttcctgtcctctttccctacccccgccctggctggtccacgtggaatgggggctgggaagactgagctggcctggccgggaggagcgggggagggggttgcaataggaggagggggccaggctgagtgtgttagagtctgagggaggcactacaaagaactctaggttccccctccccccatctccatccctggctgcgagacctggggcctggccagggagagaggctcgggaaagatgagaactctgagtggacaccaaaggaaaaaaaaaaaaaaaagttcaatgactttttccggagcccccgggtcctaaagccgggcggagatgaaccttgcttctttcgcgggcacttcgaattctagtcccctccaggtgggtggtgaagccgcggagtgtgagaggcatctccgtgctcatccgtgaccccagctgtactccaagggaaggcatctccagggaagagcagcttggtcccgcaaaagctggactgaaagaaggactttgtgacttgggatgtgacgggcacggagatggagtggggggtggtggcagcgcaaggtgtgcaggtgacagcaggtgtgtgcctccgacgtgggcgggggagacactcggagggtgcaggagggcgcagcgacggaaggcccggctccagggcttccttctcgtatgggcagcgcagaggaggcggccctcactcagtgtcctgatctcaggcgggggcactgtttgcatggggaggggcttcctgggcttcccatctctggcgggaagcgctccccgacgcattctctacctaggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactaatgctcttcgaccccaaggacagcgtcatgcagcagaacctggtgtattaccggttccaccgggctcgctggggcctggaagaggaggacttccagccccgggaggaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacacccctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacgaggagtttccagctgctggctggagtctcaggccaaattgcagagggtcctccagggtcctgaagagcactggactaagagtctagtggttccagggccctgaccagtaggtgctcaataaatgtttgttgttgaatgaaaaaaaaa

SEQ ID NO: 290946 - DNA, 1757 bp, Homo sapiens
  misc_feature (1670)..(1670): n is a, c, g, or t
  misc_feature (1731)..(1731): n is a, c, g, or t
  misc_feature (1754)..(1754): n is a, c, g, or t
aactggctccccctcttcctgtcctctttccctacccccgccctggctggtccacgtggaatgggggctgggaagactgagctggcctggccgggaggagcgggggagggggttgcaataggaggagggggccaggctgagtgtgttagagtctgagggaggcactacaaagaactctaggttccccctccccccatctccatccctggctgcgagacctggggcctggccagggagagaggctcgggaaagatgagaactctgagtggacaccaaaggaaaaaaaaaaaaaaaagttcaatgactttttccggagcccccgggtcctaaagccgggcggagatgaaccttgcttctttcgcgggcacttcgaattctagtcccctccaggtgggtggtgaagccgcggagtgtgagaggcatctccgtgctcatccgtgaccccagctgtactccaagggaaggcatctccagggaagagcagcttggtcccgcaaaagctggactgaaagaaggactttgtgacttgggatgtgacgggcacggagatggagtggggggtggtggcagcgcaaggtgtgcaggtgacagcaggtgtgtgcctccgacgtgggcgggggagacactcggagggtgcaggagggcgcagcgacggaaggcccggctccagggcttccttctcgtatgggcagcgcagaggaggcggccctcactcagtgtcctgatctcaggcgggggcactgtttgcatggggaggggcttcctgggcttcccatctctggcgggaagcgctccccgacgcattctctacctaggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaagtgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggagctaccacaaccaggaaccgncgagctgccgggaacttgcttggaagtttaaccccaacaatggttaaccccttgccaagtncaggaatgggaattgaaggaatnggg

SEQ ID NO: 290947 - DNA, 450 bp, Homo sapiens
tggtgccactcctgccttccttgtcagtggcagacattgctaatcgattgagggactctttgtcaccaaactctcagaatccttaacccagtgttccaagcagccacgatgatctgatgagcttgtgagctgatacctattctctgatccttgagctagaagagggccagtgggcccagatcctaggagccctggcttcttgccatctggcaacagggtatggctcaccccccaccccgtccttccctccttccaggaggccatgctctaccacaaccagaccgccgagctgcgggagctgctggagttcacccacatgtacctgcagtcagatgatgaggtgagtgcctcctgctttccaggattgggctgtgatggggacaccttggaccttttcctggggccaccagtgtgccagaattcagccccagcccctggtggtcagctgtc

SEQ ID NO: 290948 - DNA, 1496 bp, Homo sapiens
cgggtggggacgctggtcgctgccgggggcaagtctgccgactccagaaagaaaggcgaaagaatagattgtgaagctaagtgctgtgagggaaaccagaggcagctgagatgtcgtggaagtaacagcgaatgaagccaggatgctggattctgaccttggaactgttctgagaggctgtttgatgcaagactcccacctgcgggtatcatagtccagggtaaggccattgggccaacccaggtctgtgttgatgaggaccttccgctcagaaccatccaagtttgcccgttcgatcttggcaatgtggccccagtctgtccagaagaggtacctgagacacaacagtgccatcatcatcaaggcatgggaagacagcacccagaggttgagagaacacagaggacccactaacaccatctttccacccagcccttcttccctggatctctcttctgctggccataaacttaccccttcctggggaaaacagcaatggcccggggctcatccaggctattgttgatcagtactttgcggcaggaaccatccagcctggacgcctcaatggtatttcgacctgtgtctgtccagtacaggttcctggccacccagtccactgccagcccgtcagtggtcttcagccctcgcccgatcactgtctccatgttgctgccgttcaggtctgctcgccttggggagagcccagtgttggatgagcaaccagactgacccagaatagagtagaactttaacccatgttcccataactggaccccactgaactgtaagctccacagggatagagaccaggtatctatgagtacattcctcagcacccagcatgatagatgctcaataaaataattgcagaatgaaggaaccagttcttaggaggacacagtatttcctgctaactggacataatggcggttgccaggggatgtcttgctagaagacaagtttatcattccccacatacctttgggaagagacaaggattgctaggtggtgatgataagaaacgcagatttgtcaaaaccaacctgtgcattttttaaaagttaaaaacaattttaaatacaagtagatatgaggtttcattatgttgcctaggctggtcttgaactcctgggctcaagcaatcttcccgccttggcctcccaaagtgctgggattataggcgcgagctaccacgccagaccctaactgtgcacttttgcaaaggccctatgggcaggagggaactctacctcagaatggggagcatgtcactgtcacctaggggacttccctaaactgtatatgcctacctgtccccagtttgagattctaatacatcccttggggagagcaaaggggaatgttccctgttcctccatgtgagaatatctgccatggtaaaccactcttactggtggcaggacatcatattcctaagctgtgttagggccacaaatttaaagactaaaaataaaacaacgaaaaaataaaaa

SEQ ID NO: 290949 - DNA, 475 bp, Homo sapiens
gtctccgaggcagattgcgtgcgggaagaggctcccgctgaactccagcgccacgcgctgcacgtagctaactgacctcatggcacctccaagagcagagggagcggagaggcccagtaaatattccctgaacccccgtcgcgacagccgccagagcggaaggccacctaaggcagcaagttacgtcactgcctgaacctccaatctctgcctcttcctcctttaaccttacagaggaggcgggtcttccgggcttggaggcgggcttcccaactctgatgatgcagagctggaagaaacctcaggaatgctttcgattttgcagatgaggacagaagcccaggacttgccaaaggaacctcatgggagagtctggattagttcagagacctcacctttccatttaacttctgagtcttggttttcttatctgtaaatagggttattaaagttataccttctttgtaaaaaaaaa

SEQ ID NO: 290950 - DNA, 358 bp, Homo sapiens
cctgagaatcttactaatcttcgtaataactgataattgcatggttttgaaaagtgtttttaaaaaactacccattaggagtgaaaacaatgtagtgagttgcaatcagcatataaaaaattaaatacaatagtaatataccaagtgactcccaggtagtaaggatgcagagctggaagaaacctcaggaatgctttcgattttgcagatgaggacagaagcccaggacttgccaaaggaacctcatgggagagtctggattagttcagagacctcacctttccatttaacttctgagtcttggttttcttatctgtaaatagggttattaaagttataccttctttgtaaaaaaaaa

SEQ ID NO: 290951 - DNA, 2164 bp, Homo sapiens
gcaaagccagctgggctcctgagtccggtgggtacttggagaacttactacgtctagctggaggattgtaaatgcaccaatcagcatgctgtgtctagctcaagattttctccatccccttattttgggccagtggctgtcattacatatgagatgagtctcttgaagactacagatgaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagagaacaaagtcgtggacaaccaggctgggacccagggccagctgaaggtgctgggtgccaacctctggtggccgtacctgatgcacgaacaccccgcctacctgtactcctgggaggatggtgattgctcacaccaaagccttggacccctcccagcctgtgacctttgggaccaactccacctacgcagcagacaagggggctctgtatgtggatgtgatccgtgtgaacagctactactcttggtatcgcaactacgggcacctggagttgattcggctgcagctggccgcccagtttgagaattggtgtgagacatcacaatcccattattcagagcgcgtatggagtggaaacgcttgtagggtttcaccagggctggtgaattaccagatctccgtcaagtgcagtaaccagttcaagttggaagtgtgtcttttgaatgcagaaaacaaagtcgtggacaaccaggctgggacccagggccagctgaaggtgctggtgccaacctctggtggccgtacctgatgcacgaacaccccgcctacctgtactcgtgggaggatggtgattgctcacaccaaagccttggacccctcccagcctgtgacctttgggaccaactccacctacgcagcagacaagggggctctgtatgtggatgtgatccgtgtgaacagctactactcttggtatcgcaactacgggcacctggagttgattcggctgcagctggccgcccagtttgagaattggtgtaagacatcacaatcccattattcagagcgcgtatggagtggaaacgcttgtagggtttcaccagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcatttcaagatgaaaatggaccagccgcagtggctcacgcctgtaataccagcactttgggaggctgaggcaggcggatcacttgaggtcaggagtttgaaactagcctggccaacgtggcaaaactccatctctattaaaaatacaaaaattagccaggcatagtggtgcatgcctgtagtcccagctacttgggatgctgaggcaggaagaattgcttgaacctgggaggcagagtctgcagtgagccgagatcatgccactgcactccagcctgggtgacagagccagactccgtctcaaaaaaaaaagaaaaagaaaatgaataaaaataaaaatctcaggaaagaagtttactgattggtgcttctaaggactggtttgcttgtacctgagacacgttgcctactatcagtttggtcctgcctgcactctggagaagccacaagaatcttgacttttgctcatacacgacactgttgcaatgctgctcctctttggaagctctttggacaattataaatactcttttttttgcaactgccctgtatacaaatatatttacaaatacatataatcccacgtgctacttcaaagttcttacctggcactataggaccaactgctattgaatcttcaagattgctttcacttgtggtttcctttgaaaaataaaatcttttcttaaatcaaaaaaaaaaacctc

SEQ ID NO: 290952 - DNA, 1404 bp, Homo sapiens
cagatattttctatggtttagattgcttatgagaaccaatatagggtttggtttctcactgacattaaagccatcactgaaaatatagctttaaaaaaaactatttgtcaacattgaaatctgaacaacgataaggaaaatcttttaaagtcatatacataaattcccttcccgaagctcatactgtccaaaataagtttatttaaaaatactcacagagagatgtagttgccattgttcaataagaaaatggagttgtgcacatttggtaccaccacacccagcctcaaaatatggccctttttaaagagtgcttaatatgactctgtgtccatagaaacattttaaaccaccattgtaatattataactcttaccaaatgggacggcttgaaaaaatgaatccgaaaacttaatttctgtgagtttcttacaggaaacaagcatagtcatgagagacccaaaatccgaaaagaagttacacttcagatggaaaacatgaagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcatttcaagatgaaaatggaccagccgcagtggctcacgcctgtaataccagcactttgggaggctgaggcaggcggatcacttgaggtcaggagtttgaaactagcctggccaacgtggcaaaactccatctctattaaaaatacaaaaattagccaggcatagtggtgcatgcctgtagtcccagctacttgggatgctgaggcaggaagaattgcttgaacctgggaggcagagtctgcagtgagccgagatcatgccactgcactccagcctgggtgacagagccagactccgtctcaaaaaaaaaagaaaaagaaaatgaataaaaataaaaatctcaggaaagaagtttactgattggtgcttctaaggactggtttgcttgtacctgagacacgttgcctactatcagtttggtcctgcctgcactctggagaagccacaagaatcttgacttttgctcatacacgacactgttgcaatgctgctcctctttggaagctctttggacaattataaatactcttttttttgcaactgccctgtatacaaatatatttacaaatacatataatcccacgtgctacttcaaagttcttacctggcactataggaccaactgctattgaatcttcaagattgctttcacttgtggtttcctttgaaaaataaaatcttttcttaaatcaaaaaaaaaaacctc

SEQ ID NO: 290953 - DNA, 745 bp, Homo sapiens
tgttttatttttgtttttaccactatacaaatgagcaggaagcattcattttaaaatctgtatgtgttcatattcatttctaaaaaaaaaactcttactaattacatagtgaaaacacaaatttcttcttgcaattaaacatttctaaagagtttgatgggtaaaaaaaaattaagtttaaagattcatagaaaagaaatatttcttcataaaattttagaacagatatttttctgaaagcttccagcacaggaaaaaaaaaaattttgtttgcagtaaaaggattgacaagcagaaaggcatggaacttctcgacagcacattaggaaccagtagaaatgtagcagtgcctctacaatttagaattaaaatgacttccaacctataattctacacctagctaaactatcaaataagtgtgagaatacaggaaaaacatatatctagatagatctatatgtctgtatatgcattatatgcaactaaaagtgtgtatttcttatgcagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcatttcaagatgaaaatggaccagccgcagtggctcacgcctg

SEQ ID NO: 290954 - DNA, 1513 bp, Homo sapiens
  misc_feature (81)..(81): n is a, c, g, or t
tcgacttagagatcccctccgaacggttatccccagtgcccagacatttctcatccaccagcagaagactgttgatggggncaccatgagccttggaaacacgtctttccagttggccctgctccacatctagaacatggatggctttgtccttggagacagtaatgagctctggggaaaaggtgcccaggtcatggtgctgctcactgctcccttccaccacattgctggttgtcttccccagtactcactctgctcatcttcagagaaggccacagctcggcaggccttgagatggtgacctgatgaccagagctccttggtttctccctcttggcaagagtaggaaaagctggggagagggcaaggagggtaaatgactcccacacccagcctcaaaatatggccctttttaaagagtgcttaatatgactctgtgtccatagaaacattttaaaccaccattgtaatattataactcttaccaaatgggacggcttgaaaaaatgaatccgaaaacttaatttctgtgagtttcttacaggaaacaagcatagtcatgagagacccaaaatccgaaaagaagttacacttcagatggaaaacatgaagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcatttcaagatgaaaatggaccagccgcagtggctcacgcctgtaataccagcactttgggaggctgaggcaggcggatcacttgaggtcaggagtttgaaactagcctggccaacgtggcaaaactccatctctattaaaaatacaaaaattagccaggcatagtggtgcatgcctgtagtcccagctacttgggatgctgaggcaggaagaattgcttgaacctgggaggcagagtctgcagtgagccgagatcatgccactgcactccagcctgggtgacagagccagactccgtctcaaaaaaaaaagaaaaagaaaatgaataaaaataaaaatctcaggaaagaagtttactgattggtgcttctaaggactggtttgcttgtacctgagacacgttgcctactatcagtttggtcctgcctgcactctggagaagccacaagaatcttgacttttgctcatacacgacactgttgcaatgctgctcctctttggaagctctttggacaattataaatactcttttttttgcaactgccctgtatacaaatatatttacaaatacatataatcccacgtgctacttcaaagttcttacctggcactataggaccaactgctattgaatcttcaagattgctttcacttgtggtttcctttgaaaaataaaatcttttcttaaatcaaaaaaaaaaacctc

SEQ ID NO: 290955 - DNA, 844 bp, Homo sapiens
tggcatccatgtcactgaggtggcttctgtctgactccaatgtcaataataatagcagtgactaacattaattggccactttccatgtacaagacatcatagtaagcgttttctgtaaatgatcacacttaatcctcacagtgctgctatgagtcagatactttacagacaacaggacggaagtcagagaggccacaggcctaatgattggctgcctggtctaccctgatggttgggactcaagtgaggtgcggcgcatgtgtggggagcagacgggcaagtacacgctgggccactgcaccatccgctgggccttcatgctggccatcctcagcattggcgacgccctcatcctctccttcctggccttcgtgttgggctaccggcaggacaagctcctccctgacgactacaaggcagatggaaccgaggaggtgtgaagcagctgaagggtcgatggaatttcgctcttgttgcccaagctggagtgcaatggtgcgatctcggctcactgcaacctccacctcctgggttcaagccattctcctgcctcagcctcccgagtagctgggattacaggaacatgtctgatttcaggagtacccaatgaaggatccgatgaatggctggccagttactcagagtaatatgtttatgagttaaatggattgcataacggcaccacttttcctttgtcactgtggtggataaatgacaaagtagattccaatctcctgtatagaaaggtggttacccaatagcctcactggtggcttgctagcagagcctcaagttgcacctctgtggctttctgtaaattcgagtcctacagccacttcgagaa

SEQ ID NO: 290956 - DNA, 442 bp, Homo sapiens
tctgctcccaggggccctgggacgctgggctgcccgctctgccctaaggccttccctctgcagcgcatgctgacaaggcacctcaagtgccacagccccgtgcgccgccacctgtgccgctgttgtggcaagggctttcatgacgccttcgatctcaagcgccacatgaggactcacactgggatccggcccttccgctgcagtgcttgcgggaaagcgtttacgcagcgctgctccctggaagctcaccttgctaaggtgcatggacagccggccagctacgcttaccgtgagcgccgcgagaagctgcacgtgtgcgaggactgcggcttcaccagctcccggcccgacacctacgcacagcaccgcgccctgcaccgcgcagcctgatacggtgtgccagcgtcctccccacgaggcaaataaacacagaaaactcacg

SEQ ID NO: 290957 - DNA, 498 bp, Homo sapiens
agaaaaactaggaacaaaaaagatatatataagtctctgatacttacatatatttggagaacatgttggagaattggaaggggaaagtcggcattcaaaaatgcaaagcaacttcactttataacagcctgctctcacaggaagtgatacttccagaaaaataagtttgtattgagcatgcactacatgcaaggcaattttattttatatgggatattggacctaataagaagaggagcttgatgaattttaggcagaatgacttaagggctgtagactaaataaaaagcaaaaaggatagggacatttctatgtgttttgatatgaaataaaaaactaataataaggcttacaaacttaagtcatcccaactggcctcacaaaactcaagtgtggtgccaggtagagagccaaatagcagtggaagatttggatggtaggtcaggttcccatttattatgtttagtctagtacaaggaatagagagaattgaatgga

SEQ ID NO: 290958 - DNA, 390 bp, Homo sapiens
ggacctcacccctgagcaggtcaggactcagaacagtctggcgtctccagactctcacatgcagtatgtgcaggcacctgatacttctgttgcccttgtgctccagtcattgcacaaggcagaaaacagctctggcaggaagggactgccaaagttaggagccctagggcctggaaggagagtatggtcctcagatcccccttctctcctgcttcctccagggaacccaacagtcatgaccctgatagtttcccataacaacctgggcattccttgggactcaggagctgctaaactctttcatcccctggtggcttcagcagtccttatcaccaacagctcgactaacagatcgccaaccgatcggccaccagatcgcccaccagctcg

SEQ ID NO: 290959 - DNA, 571 bp, Homo sapiens
ggacctcacccctgagcaggtcaggactcagaacagtctggcgtctccagactctcacatgcagtatgtgcaggcacctgatacttctgttgcccttgtgctccagtcattgcacaaggcagaaaacagctctggcaggaagggactgccaaagttaggagccctagggcctggaaggagagtatggtcctcagatcccccttctctcctgcttcctccagggaacccaacagtcatgaccctgatagtttcccataacaacctgggcattccttgggactcaggagctgctaaactctttcatcccctggtggcttcagcagtccttatcaccagcctcacaatcccacaggcccacccccagtgggcctgtggcattcatatttcatattcatatttcaaaccacaatatccagcaaaatgtctcctgagcacccagaactccataccatcggccgggtgtggtggctcatgccttaatcccagcactttgggaggtcaagatgggaggattgcttgagcccagaagttcgagactagcctgggaaacataggaagccctcgtctctac

SEQ ID NO: 290960 - DNA, 467 bp, Homo sapiens
gaagctactacccttccaaagctatgattctcaagataactattaccatcccagcaggatgggcagtccaggggccaactggtcccactgctggagcagatcacacaggacggccagggccagggccagagcgatggaggcatccacctggcagaaggcaaactctgcaaagacaggagaaagtgtcaccagaaggatcaggaaggcttccctgtccagtgtctcctctgcacatctgcctggatttgactggtttgccctttccttggaaagcagatctcttgggcacaagacacatcctagagcagggcatcggcaagcttttccttaaagggccagagagtcaatattttagactttgcaagcctatacctcctcacctcggctgaaagcagccatggacaatctgtaaacaaatggttgtggctgtgttccaataaaactttatttatggacactgaaatttg

SEQ ID NO: 290961 - DNA, 351 bp, Homo sapiens
atgaatatactgctcagggccgaccccagggcagcctgcaggaccctgggaacaataaaggcctcagtgtcaccagaaggatcaggaaggcttccctgtccagtgtctcctctgcacatctgcctggatttgactggtttgccctttccttggaaagcagatctcttgggcacaagacacatcctagagcagggcatcggcaagcttttccttaaagggccagagagtcaatattttagactttgcaagcctatacctcctcacctcggctgaaagcagccatggacaatctgtaaacaaatggttgtggctgtgttccaataaaactttatttatggacactgaaatttg

SEQ ID NO: 290962 - DNA, 667 bp, Homo sapiens
aggcagcacaatggctggcactctgaggaagccggactcatcccgtgcaggccgcatacacactccactgcccttccggccaaacaagcccggacacgggagagggatgagagtcggggatgcctagcggcgaggagagaagggataggcaaaagggaagaagagcgggctgtgatacctcctcgacgccgtcaaacactgctccccgcattccagagcccggggcccacccgacggcagcgcgccccgccaccgcgcagccgccccggtcccttctcccgcccgtctgtagtaaaacaatcgctctcccggcgtctgcggccgctgccagcggttctgacactgcaggaatgcgcggtctggggaaggctccgcactctggggaggggcacgagcggggtcggggaaactccaagatgaaagcgtgcaataactaccaatatggatacctcgcaaagcctgacactagtttctggataaaatgcaggcgatggctgctggcggatgccggcagacacactcaaagacccttttggactttccgagtttcccattctcctctactggaggctgaggcgggcaggcccagcgacgtctcccagctccaactgggttcggacctcaagccaaaaatgaggaggccggcaggagagcttttctcgcccaa

SEQ ID NO: 290963 - DNA, 791 bp, Homo sapiens
gggtaaatcatactttgtccttttcatctgtggtttgttaggaaaagtttttgaagtttcaggtttcttgggtaggaatttaatctgatcacttatcttccttacaggcatactacctggcgtcttcctacatttattgctcctctgggaaagtgtaaagtctttaagatggaaagcatgagaaaatgtgtatctaatgagaaccggatatagttctgtcccttccaagttgaggtggtgtcccagaatttagtcaaactgcggctaccaaggcagtcatagtgtatattaacttgtgtgtgttacttgataaagctagatgattagtgagaagcttaagctttgaatacaggtgtttaaacgagtactatagtaataatttgaaaaatgtattggttagaatgtttttatttcagtgcacagcccagcttctgattagagaaagcatagtgatgcagaagagtctttgggtcacttaatgagaacttgggtcagagagaaaggaaaggaatcctgtgtattataggtgtgattaagagcctatattccaacaatgtatcttcttccataggcttgccacttaatattaacgcactgcttttatagtggagactttggaagtacaacagtgaggcaaaacaaaatcaatagagcttcccttaaacattttttgttggtggccagtatagtattctatttaaaaattaagttttacagtctgtaaaatatacaggacaatgacttttttaaaatgtaagttaatacctcctcctcacttgtcttaattgaac

SEQ ID NO: 290964 - DNA, 286 bp, Homo sapiens
aagtgggaggtagagaagcccactcacctccctctccagactcagggaagggaatgagaaggtgccacacagagccctggcaggaccgagggccacacaggctgcctggccgccgtcccagacctgtggccacatgagatttaggtttcgatgtggcacagcttcaaatggatacacgaggggatagtcatcttctgtgagaaacagtggcaccttttcccaaagacaaatagttaagacatcactcctattttttcagctgccccaagtaattgctcttttgacg

SEQ ID NO: 290965 - DNA, 714 bp, Homo sapiens
tgtgtgcagaatgtataatgtatttattaatgtggctcatggttaaaaacaaccaccaaacaaaacctgaccatggagtaaccagccagatgctcatctgttcacccctctccaaacctgcgtcacggcttgtacatgaaacagaacctaggaatctcaactagatccattgataccagcgaaaattgagcttccagttgaacccaccataggtcatatcagagcctgccatgtactcaaaagtatcatcactgatcacatcgatgatgggacacaccactgttctcctgatgtcataaaaggtatcactactctgtcaccacccaggctggaatgcagtagtgcaatcaggggccactgcagcctcgacctcctcaagtgatcttcccacctcagcttcctgagtagctgggaccacggctgggatcacataacaccacactcaactaattaaaaaaattttttttttgttttttatatttaagactttaatcttcaagggactgattttaactatgatatacattccgtatcaatgctagaatcggcctgtacagtctctcaaagaaaattctgtggagatttcaattggaaatgcactgaatttatatatgaatttgggtagaattgatactcttatgatattgactttcctatccatttctctctcaagattttttcgtgaatttcagtaaatcttttgataaacatatt

SEQ ID NO: 290966 - DNA, 480 bp, Homo sapiens
cagatattttctatggataaccagttgttccaccactatttatgtaatgatccctttttcttctgctgtaactatgagtgactgctctgtcataaatcaagattacatacaaaaatgagctggtttctagaccctaccctgtttcactagtctatttgtgaattcctgcatcaatataccactgccataattaacacagctttaaaataagtcttgacgcctagtaaggcaagcccccttagatctgattcttcttcagaagcatcccaactattttttttctctttacagttccgtatcaatgctagaatcggcctgtacagtctctcaaagaaaattctgtggagatttcaattggaaatgcactgaatttatatatgaatttgggtagaattgatactcttatgatattgactttcctatccatttctctctcaagattttttcgtgaatttcagtaaatcttttgataaacatatt

SEQ ID NO: 290967 - DNA, 791 bp, Homo sapiens
ggaactgaagcagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggccagtgccggggatctctgtggaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtggctgggattcgttagtgatgagcagctgcagctgagctctgtcacaagggtactccacaggaggagcagtgctgacttcagtcctgacccagaaa

SEQ ID NO: 290968 - DNA, 429 bp, Homo sapiens
ttgttatcagatctgaaaatataagatgaagacacaaaaacaatatagttacagtgggaaaatagaaaggtcgctaagataaatggcctgaaaataaatgcaaatataggtatatatttgaatgtattttatgaacttagtatataatactttatatatttttaatttatgatataaaagtatataatattagtatacagtaaaagtgacactgcaaattagtgatgaaagggatgactctttaggaagtgcactcaacactcagttaacttacacacacacacaaaaaaaaacctaccttaaataagccaccagagtaaatacagttacattccctgttgggctagtggttaggattcaaaaaatagagatacatagcaaagtattaaaagaaaacactggtaattataccagcgtttctcaacctca

SEQ ID NO: 290969 - DNA, 317 bp, Homo sapiens
agaatcatctgaagaaactgaaggaaaaataagaatttacaattgtctgttttggaaataaagctctaagtacaactttcaaaatgacctggcttattaataagcctgtagtaaagacaaattgcctgcaattttcaaggctcttagtcacctcatccttcccccaagtttcttactctttaagatacacaatactgtattctagccaagttactgtacagcaaattctcttgttactaagtcctgttttaccattgattttcaaaatctttcagttgggggaaattaaagtggtcagttacatcttcagaatctct

SEQ ID NO: 290970 - DNA, 450 bp, Homo sapiens
ggcggccgctcgcgatctagaactatgtttccatttttgtttttacaaatcctttgggtctaattctgtgagcctacctatagcactggattaaaatgtctgcatcatttctttagttatccagttaactttaaaactgttgtaaaagtgtaaaccagcccatgacaggtttttgtacatgttaaagaacttcattgttcagttttcatgattattgtgtaaggaagactgatgtagatgttctgtgctgtcctggaccatgttaattacacttacgacgtattttagttccacatcacaatgatttgtccccagtgacccttttatcctttctaggcacatttcttgttgttgttgttgttgcagttcccctttgcattgtattgctttgacaactgtaatttgaatcagatctgaaagaggtccagaataaaatatattttgatatta

SEQ ID NO: 290971 - DNA, 2714 bp, Homo sapiens
gagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgactttttcccagctgattaaaagatagtcaagaaattctgcaatatagctgccaaaatagacagctacatttttatgatattgtcatcttttctgttttttttttcttttttttctttagctattttacttaagcataatagccacaataggacatataaaagattataaatacagagctttattatcctgacgtcttgggtcttttaagtatatacttttctgaaaggtatccattttgtaggcttgggttcttcatgagcatacgattgtttatttttgctgctgttctcaacatcatcattgcctgctgatgtgccacgatgctgctccaatagacagcaataagattgtctctaatttgagcagtaacatgattgcaagagaccaagtttcacagcttgtaaagttctgtatttgggattcttgcttatttttccgcctgtgtttttctgagaacttattcctgatgatcaattgaatccagtagtttttctatgctatttgttgttgtataagctactgtaagaaacttatcataaggaaaaatagaaaggaaaacttgaatcaatactcattgattaaaatggaataaagaaagagcagctgccacttttaaacaacataaaggaatatctttttttgtctccgtgtaggaaatcccataagttcttatatttgttccagttcccatttcctgccattgaccagataacatcattgactttcaaatgacttttagaagtgataactcttaatttcctaatagatactagattgtattgaattctgttttaattattctctaggtaagtatgttttaggattaaataccttttacagatactgaaagtgcctccttttgtggtgtaaaaaacaaattatggtgcaaaaagtaatcactagattgaaatacatgaaggttttttgctttttgacatacgaaaatgtcaagagaaaggccaaagatttgtactttttcacttacaaagcactcctttttcccttaaacttctttctgtcaaattagatttaatgagagagtactatttttaaggagctatctgtttatgtagaatgattttgttaagagtaatgtaaactattattgagtagaggcctaaagaggactgtgcatttttgctatttaaaggaatcacaaatgatcatacttaagtgagcaaaaatgacaagttttactagctaagtagagaaataaatctcaaatgcagcgctacaattttcattatcttaagtacattgtacatttctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgtttgttttctttgttttttcccccttctcctgaatcagcagggatggaaggagggtagggaagttatgaattactccttccagtagtagctctgaagtgtcacatttaatatcagttttttttaaacatgattctagttaaatgtagaagagagaagaaagaggaagtgttcacttttttaatacactgatttagaaatttgatgtcttatatcagtagttctgaggtattgatagcttgctttatttctgcctttacgttgacagtgttgaagcagggtgaataactagggcatatatttttttttttggtaagctgtttcatgatgttttcttgggaatttccggataagttcaggaaaacattctgcatgttgtatctagtctgatgtacttatccatctcattacaaacaaaaacacacagactgcatttgtagctctgtaatccttgaatacggaagtaaattttcttctttcctgactttgacattgtagctatactgtttccatttttgtttttacaaatcctttgggtctaattctgtgagcctacctatagcactggattaaaatgtctgcatcatttctttagttatccagttaactttaaaactgttgtaaaagtgtaaaccagcccatgacaggtttttgtacatgttaaagaacttcattgttcagttttcatgattattgtgtaaggaagactgatgtagatgttctgtgctgtcctggaccatgttaattacacttacgacgtattttagttccacatcacaatgatttgtccccagtgacccttttatcctttctaggcacatttcttgttgttgttgttgttgcagttcccctttgcattgtattgctttgacaactgtaatttgaatcagatctgaaagaggtccagaataaaatatattttgatatta

SEQ ID NO: 290972 - DNA, 2335 bp, Homo sapiens
ctttttaacattttttccccgataactacatttttatgatattgtcatcttttctgttttttttttcttttttttctttagctattttacttaagcataatagccacaataggacatataaaagattataaatacagagctttattatcctgacgtcttgggtcttttaagtatatacttttctgaaaggtatccattttgtaggcttgggttcttcatgagcatacgattgtttatttttgctgctgttctcaacatcatcattgcctgctgatgtgccacgatgctgctccaatagacagcaataagattgtctctaatttgagcagtaacatgattgcaagagaccaagtttcacagcttgtaaagttctgtatttgggattcttgcttatttttccgcctgtgtttttctgagaacttattcctgatgatcaattgaatccagtagtttttctatgctatttgttgttgtataagctactgtaagaaacttatcataaggaaaaatagaaaggaaaacttgaatcaatactcattgattaaaatggaataaagaaagagcagctgccacttttaaacaacataaaggaatatctttttttgtctccgtgtaggaaatcccataagttcttatatttgttccagttcccatttcctgccattgaccagataacatcattgactttcaaatgacttttagaagtgataactcttaatttcctaatagatactagattgtattgaattctgttttaattattctctaggtaagtatgttttaggattaaataccttttacagatactgaaagtgcctccttttgtggtgtaaaaaacaaattatggtgcaaaaagtaatcactagattgaaatacatgaaggttttttgctttttgacatacgaaaatgtcaagagaaaggccaaagatttgtactttttcacttacaaagcactcctttttcccttaaacttctttctgtcaaattagatttaatgagagagtactatttttaaggagctatctgtttatgtagaatgattttgttaagagtaatgtaaactattattgagtagaggcctaaagaggactgtgcatttttgctatttaaaggaatcacaaatgatcatacttaagtgagcaaaaatgacaagttttactagctaagtagagaaataaatctcaaatgcagcgctacaattttcattatcttaagtacattgtacatttctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgtttgttttctttgttttttcccccttctcctgaatcagcagggatggaaggagggtagggaagttatgaattactccttccagtagtagctctgaagtgtcacatttaatatcagttttttttaaacatgattctagttaaatgtagaagagagaagaaagaggaagtgttcacttttttaatacactgatttagaaatttgatgtcttatatcagtagttctgaggtattgatagcttgctttatttctgcctttacgttgacagtgttgaagcagggtgaataactagggcatatatttttttttttggtaagctgtttcatgatgttttcttgggaatttccggataagttcaggaaaacattctgcatgttgtatctagtctgatgtacttatccatctcattacaaacaaaaacacacagactgcatttgtagctctgtaatccttgaatacggaagtaaattttcttctttcctgactttgacattgtagctatactgtttccatttttgtttttacaaatcctttgggtctaattctgtgagcctacctatagcactggattaaaatgtctgcatcatttctttagttatccagttaactttaaaactgttgtaaaagtgtaaaccagcccatgacaggtttttgtacatgttaaagaacttcattgttcagttttcatgattattgtgtaaggaagactgatgtagatgttctgtgctgtcctggaccatgttaattacacttacgacgtattttagttccacatcacaatgatttgtccccagtgacccttttatcctttctaggcacatttcttgttgttgttgttgttgcagttcccctttgcattgtattgctttgacaactgtaatttgaatcagatctgaaagaggtccagaataaaatatattttgatatta

SEQ ID NO: 290973 - DNA, 3073 bp, Homo sapiens
gagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgactttttcccagctgattaaaagatagtcaagaaattctgcaatatagctgccaaaatagacagctacatttttatgatattgtcatcttttctgttttttttttcttttttttctttagctattttacttaagcataatagccacaataggacatataaaagattataaatacagagctttattatcctgacgtcttgggtcttttaagtatatacttttctgaaaggtatccattttgtaggcttgggttcttcatgagcatacgattgtttatttttgctgctgttctcaacatcatcattgcctgctgatgtgccacgatgctgctccaatagacagcaataagattgtctctaatttgagcagtaacatgattgcaagagaccaagtttcacagcttgtaaagttctgtatttgggattcttgcttatttttccgcctgtgtttttctgagaacttattcctgatgatcaattgaatccagtagtttttctatgctatttgttgttgtataagctactgtaagaaacttatcataaggaaaaatagaaaggaaaacttgaatcaatactcattgattaaaatggaataaagaaagagcagctgccacttttaaacaacataaaggaatatctttttttgtctccgtgtaggaaatcccataagttcttatatttgttccagttcccatttcctgccattgaccagataacatcattgactttcaaatgacttttagaagtgataactcttaatttcctaatagatactagattgtattgaattctgttttaattattctctaggtaagtatgttttaggattaaataccttttacagatactgaaagtgcctccttttgtggtgtaaaaaacaaattatggtgcaaaaagtaatcactagattgaaatacatgaaggttttttgctttttgacatacgaaaatgtcaagagaaaggccaaagatttgtactttttcacttacaaagcactcctttttcccttaaacttctttctgtcaaattagatttaatgagagagtactatttttaaggagctatctgtttatgtagaatgattttgttaagagtaatgtaaactattattgagtagaggcctaaagaggactgtgcatttttgctatttaaaggaatcacaaatgatcatacttaagtgagcaaaaatgacaagttttactagctaagtagagaaataaatctcaaatgcagcgctacaattttcattatcttaagtacattgtacatttctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgtttgttttctttgttttttcccccttctcctgaatcagcagggatggaaggagggtagggaagttatgaattactccttccagtagtagctctgaagtgtcacatttaatatcagttttttttaaacatgattctagttaaatgtagaagagagaagaaagaggaagtgttcacttttttaatacactgatttagaaatttgatgtcttatatcagtagttctgaggtattgatagcttgctttatttctgcctttacgttgacagtgttgaagcagggtgaataactagggcatatatttttttttttggtaagctgtttcatgatgttttcttgggaatttccggataagttcaggaaaacattctgcatgttgtatctagtctgatgtacttatccatctcattacaaacaaaaacacacagactgcatttgtagctctgtaatccttgaatacggaagtaaattttcttctttcctgactttgacattgtagctatactgtttccatttttgtttttacaaatcctttgggtctaattctgtgagcctacctatagcactggattaaaatgtctgcatcatttctttagttatccagttaactttaaaactgttgtaaaagtgtaaaccagcccatgacaggtttttgtacatgttaaagaacttcattgttcagttttcatgattattgtgtaaggaagactgatgtagatgttctgtgctgtcctggaccatgttaattacacttacgacgtattttagttccacatcacaatgatttgtccccagtgacccttttatcctttctaggcacatttcttgttgttgttgttgttgcagttcccctttgcattgtattgctttgacaactgtaatttgaatcagatctgaaagaggtccagaataaaatatattttgatattaaaaaaaaaaaaaaaaaaaaaaaaaaaaaaaaaaaaaaaaaaaaaaaaaaaaacacagtgtgtgtggggccgcgccacagggcccacaagaaagacacttcaaaaacacacaggggtgggacgcggaggacccccaaaagagaaagcgaaacaggggcacaaagagcgcacccaagagaaacaccggggcagagacaacaggaggcgaggggtctcacacacaaaaaaaaaaaacggcacgggggagacacacgagaggtgttgtgaaaacgacacccacaagagggatacacagaagagaaaagacgggggaaccacataacaaggagagatccaaggagaccagcaaaataaataccg

SEQ ID NO: 290974 - DNA, 3198 bp, Homo sapiens
gagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgactttttcccagctgattaaaagatagtcaagaaattctgcaatatagctgccaaaatagacagctacatttttatgatattgtcatcttttctgttttttttttcttttttttctttagctattttacttaagcataatagccacaataggacatataaaagattataaatacagagctttattatcctgacgtcttgggtcttttaagtatatacttttctgaaaggtatccattttgtaggcttgggttcttcatgagcatacgattgtttatttttgctgctgttctcaacatcatcattgcctgctgatgtgccacgatgctgctccaatagacagcaataagattgtctctaatttgagcagtaacatgattgcaagagaccaagtttcacagcttgtaaagttctgtatttgggattcttgcttatttttccgcctgtgtttttctgagaacttattcctgatgatcaattgaatccagtagtttttctatgctatttgttgttgtataagctactgtaagaaacttatcataaggaaaaatagaaaggaaaacttgaatcaatactcattgattaaaatggaataaagaaagagcagctgccacttttaaacaacataaaggaatatctttttttgtctccgtgtaggaaatcccataagttcttatatttgttccagttcccatttcctgccattgaccagataacatcattgactttcaaatgacttttagaagtgataactcttaatttcctaatagatactagattgtattgaattctgttttaattattctctaggtaagtatgttttaggattaaataccttttacagatactgaaagtgcctccttttgtggtgtaaaaaacaaattatggtgcaaaaagtaatcactagattgaaatacatgaaggttttttgctttttgacatacgaaaatgtcaagagaaaggccaaagatttgtactttttcacttacaaagcactcctttttcccttaaacttctttctgtcaaattagatttaatgagagagtactatttttaaggagctatctgtttatgtagaatgattttgttaagagtaatgtaaactattattgagtagaggcctaaagaggactgtgcatttttgctatttaaaggaatcacaaatgatcatacttaagtgagcaaaaatgacaagttttactagctaagtagagaaataaatctcaaatgcagcgctacaattttcattatcttaagtacattgtacatttctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgtttgttttctttgttttttcccccttctcctgaatcagcagggatggaaggagggtagggaagttatgaattactccttccagtagtagctctgaagtgtcacatttaatatcagttttttttaaacatgattctagttaaatgtagaagagagaagaaagaggaagtgttcacttttttaatacactgatttagaaatttgatgtcttatatcagtagttctgaggtattgatagcttgctttatttctgcctttacgttgacagtgttgaagcagggtgaataactagggcatatatttttttttttggtaagctgtttcatgatgttttcttgggaatttccggataagttcaggaaaacattctgcatgttgtatctagtctgatgtacttatccatctcattacaaacaaaaacacacagactgcatttgtagctctgtaatccttgaatacggaagtaaattttcttctttcctgactttgacattgtagctatactgtttccatttttgtttttacaaatcctttgggtctaattctgtgagcctacctatagcactggattaaaatgtctgcatcatttctttagttatccagttaactttaaaactgttgtaaaagtgtaaaccagcccatgacaggtttttgtacatgttaaagaacttcattgttcagttttcatgattattgtgtaaggaagactgatgtagatgttctgtgctgtcctggaccatgttaattacacttacgacgtattttagttccacatcacaatgatttgtccccagtgacccttttatcctttctaggcacatttcttgttgttgttgttgttgcagttcccctttgcattgtattgctttgacaactgtaatttgaatcagatctgaaagaggtccagaataaaatatattttgatattagttggctgtgtacatatataaaacctttgatgtctatgtagtttatatagactatttactagtcaggtaaagagagagggatggtatttcttgtttacagtttgtttacattttaattgcttttacttctccagtgttctattgtagaataaacctttttttccaagttagccttcataacctataacacattcattctctcccatactggtgttactgattaataactgccatcagaacccaaaccactgtttttcataaacgtattgtttcccaagatatatactttaagcccataataaaattacaaattttactatttttattacttcttgcaggagataagatttttttaaatgaaggggttatttactatttttattaaagtataatagagcatctaatcagctaagggattgtaatttttaattcttttgaaaaataaatattgtatttaaaagacgttatttcacagaagctgaaa

SEQ ID NO: 290975 - DNA, 2662 bp, Homo sapiens
gagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgactttttcccagctgattaaaagatagtcaagaaattctgcaatatagctgccaaaatagacagctacatttttatgatattgtcatcttttctgttttttttttcttttttttctttagctattttacttaagcataatagccacaataggacatataaaagattataaatacagagctttattatcctgacgtcttgggtcttttaagtatatacttttctgaaaggtatccattttgtaggcttgggttcttcatgagcatacgattgtttatttttgctgctgttctcaacatcatcattgcctgctgatgtgccacgatgctgctccaatagacagcaataagattgtctctaatttgagcagtaacatgattgcaagagaccaagtttcacagcttgtaaagttctgtatttgggattcttgcttatttttccgcctgtgtttttctgagaacttattcctgatgatcaattgaatccagtagtttttctatgctatttgttgttgtataagctactgtaagaaacttatcataaggaaaaatagaaaggaaaacttgaatcaatactcattgattaaaatggaataaagaaagagcagctgccacttttaaacaacataaaggaatatctttttttgtctccgtgtaggaaatcccataagttcttatatttgttccagttcccatttcctgccattgaccagataacatcattgactttcaaatgacttttagaagtgataactcttaatttcctaatagatactagattgtattgaattctgttttaattattctctaggtaagtatgttttaggattaaataccttttacagatactgaaagtgcctccttttgtggtgtaaaaaacaaattatggtgcaaaaagtaatcactagattgaaatacatgaaggttttttgctttttgacatacgaaaatgtcaagagaaaggccaaagatttgtactttttcacttacaaagcactcctttttcccttaaacttctttctgtcaaattagatttaatgagagagtactatttttaaggagctatctgtttatgtagaatgattttgttaagagtaatgtaaactattattgagtagaggcctaaagaggactgtgcatttttgctatttaaaggaatcacaaatgatcatacttaagtgagcctacaattttcattatcttaagtacattgtacatttctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgtttgttttctttgttttttcccccttctcctgaatcagcagggatggaaggagggtagggaagttatgaattactccttccagtagtagctctgaagtgtcacatttaatatcagttttttttaaacatgattctagttaaatgtagaagagagaagaaagaggaagtgttcacttttttaatacactgatttagaaatttgatgtcttatatcagtagttctgaggtattgatagcttgctttatttctgcctttacgttgacagtgttgaagcagggtgaataactagggcatatatttttttttttggtaagctgtttcatgatgttttcttgggaatttccggataagttcaggaaaacattctgcatgttgtatctagtctgatgtacttatccatctcattacaaacaaaaacacacagactgcatttgtagctctgtaatccttgaatacggaagtaaattttcttctttcctgactttgacattgtagctatactgtttccatttttgtttttacaaatcctttgggtctaattctgtgagcctacctatagcactggattaaaatgtctgcatcatttctttagttatccagttaactttaaaactgttgtaaaagtgtaaaccagcccatgacaggtttttgtacatgttaaagaacttcattgttcagttttcatgattattgtgtaaggaagactgatgtagatgttctgtgctgtcctggaccatgttaattacacttacgacgtattttagttccacatcacaatgatttgtccccagtgacccttttatcctttctaggcacatttcttgttgttgttgttgttgcagttcccctttgcattgtattgctttgacaactgtaatttgaatcagatctgaaagaggtccagaataaaatatattttgatatta

SEQ ID NO: 290976 - DNA, 2313 bp, Homo sapiens
gagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgactttttcccagctgattaaaagatagtcaagaaattctgcaatatagctgccaaaatagacagctacatttttatgatattgtcatcttttctgttttttttttcttttttttctttagctattttacttaagcataatagccacaataggacatataaaagattataaatacagagctttattatcctgacgtcttgggtcttttaagtatatacttttctgaaaggtatccattttgtaggcttgggttcttcatgagcatacgattgtttatttttgctgctgttctcaacatcatcattgcctgctgatgtgccacgatgctgctccaatagacagcaataagattgtctctaatttgagcagtaacatgattgcaagagaccaagtttcacagcttgtaaagttctgtatttgggattcttgcttatttttccgcctgtgtttttctgagaacttattcctgatgatcaattgaatccagtagtttttctatgctatttgttgttgtataagctactgtaagaaacttatcataaggaaaaatagaaaggaaaacttgaatcaatactcattgattaaaatggaataaagaaagagcagctgccacttttaaacaacataaaggaatatctttttttgtctccgtgtaggaaatcccataagttcttatatttgttccagttcccatttcctgccattgaccagataacatcattgactttcaaatgacttttagaagtgataactcttaatttcctaatagatactagattgtattgaattctgttttaattattctctaggtaagtatgttttaggattaaataccttttacagatactgaaagtgcctccttttgtggtgtaaaaaacaaattatggtgcaaaaagtaatcactagattgaaatacatgaaggttttttgctttttgacatacgaaaatgtcaagagaaaggccaaagatttgtactttttcacttacaaagcactcctttttcccttaaacttctttctgtcaaattagatttaatgagagagtactatttttaaggagctatctgtttatgtagaatgattttgttaagagtaatgtaaactattattgagtagaggcctaaagaggactgtgcatttttgctatttaaaggaatcacaaatgatcatacttaagtgagcaaaaatgacaagttttactagctaagtagagaaataaatctcaaatgcagcgctacaattttcattatcttaagtacattgtacatttctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgtttgttttctttgttttttcccccttctcctgaatcagcagggatggaaggagggtagggaagttatgaattactccttccagtagtagctctgaagtgtcacatttaatatcagttttttttaaacatgattctagttaaatgtagaagagagaagaaagaggaagtgttcacttttttaatacactgatttagaaatttgatgtcttatatcagtagttctgaggtattgatagcttgctttatttctgcctttacgttgacagtgttgaagcagggtgaataactagggcatatatttttttttttggtaagctgtttcatgatgttttcttgggaatttccggataagttcaggaaaacattctgcatgttgtatctagtctgatgtacttatccatctcattacaaacaaaaacacacagactgcatttgtagctctgtaatccttgaataccgacagtgtttttacaatccctttggggtcacatccgtgagtcaaactttatgctctggcttaaacgtc

SEQ ID NO: 290977 - DNA, 1146 bp, Homo sapiens
gtgactccagaggattacctagcacttcccattgtacatttctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgtttgttttctttgttttttcccccttctcctgaatcagcagggatggaaggagggtagggaagttatgaattactccttccagtagtagctctgaagtgtcacatttaatatcagttttttttaaacatgattctagttaaatgtagaagagagaagaaagaggaagtgttcacttttttaatacactgatttagaaatttgatgtcttatatcagtagttctgaggtattgatagcttgctttatttctgcctttacgttgacagtgttgaagcagggtgaataactagggcatatatttttttttttggtaagctgtttcatgatgttttcttgggaatttccggataagttcaggaaaacattctgcatgttgtatctagtctgatgtacttatccatctcattacaaacaaaaacacacagactgcatttgtagctctgtaatccttgaatacggaagtaaattttcttctttcctgactttgacattgtagctatactgtttccatttttgtttttacaaatcctttgggtctaattctgtgagcctacctatagcactggattaaaatgtctgcatcatttctttagttatccagttaactttaaaactgttgtaaaagtgtaaaccagcccatgacaggtttttgtacatgttaaagaacttcattgttcagttttcatgattattgtgtaaggaagactgatgtagatgttctgtgctgtcctggaccatgttaattacacttacgacgtattttagttccacatcacaatgatttgtccccagtgacccttttatcctttctaggcacatttcttgttgttgttgttgttgcagttcccctttgcattgtattgctttgacaactgtaatttgaatcagatctgaaagaggtccagaataaaatatattttgatatta

SEQ ID NO: 290978 - DNA, 1749 bp, Homo sapiens
gagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgactttttcccagctgattaaaagatagtcaagaaattctgcaatatagctgccaaaatagacagctacatttttatgatattgtcatcttttctgttttttttttcttttttttctttagctattttacttaagcataatagccacaataggacatataaaagattataaatacagagctttattatcctgacgtcttgggtcttttaagtatatacttttctgaaaggtatccattttgtaggcttgggttcttcatgagcatacgattgtttatttttgctgctgttctcaacatcatcattgcctgctgatgtgccacgatgctgctccaatagacagcaataagattgtctctaatttgagcagtaacatgattgcaagagaccaagtttcacagcttgtaaagttctgtatttgggattcttgcttatttttccgcctgtgtttttctgagaacttattcctgatgatcaattgaatccagtagtttttctatgctatttgttgttgtataagctactgtaagaaacttatcataaggaaaaatagaaaggaaaacttgaatcaatactcattgattaaaatggaataaagaaagagcagctgccacttttaaacaacataaaggaatatctttttttgtctccgtgtaggaaatcccataagttcttatatttgttccagttcccatttcctgccattgaccagataacatcattgactttcaaatgacttttagaagtgataactcttaatttcctaatagatactagattgtattgaattctgttttaattattctctaggtaagtatgttttaggattaaataccttttacagatactgaaagtgcctccttttgtggtgtaaaaaacaaattatggtgcaaaaagtaatcactagattgaaatacatgaaggttttttgctttttgacatacgaaaatgtcaagagaaaggccaaagatttgtactttttcacttacaaagcactcctttttcccttaaacttctttctgtcaaattagatttaatgagagagtactatttttaaggagctatctgtttatgtagaatgattttgttaagagtaatgtaaactattattgagtagaggcctaaagaggactgtgcatttttgctatttaaaggaatcacaaatgatcatacttaagtgagcaaaaatgacaagttttactagctaagtagagaaataaatctcaaatgcagcgctacaattttcattatcttaagtacattgtacatttctacagaacctgtgattattctcgcatgataaggatggtacttgcatatggtgaattactactgttgacagtttccgcagaaatcctatttcagtggaccaacattgtgcagccagccataagggtcgctagtcagcacc

SEQ ID NO: 290979 - DNA, 2462 bp, Homo sapiens
agagagagagagagagagagagagagagagagagagagagagagagacacgatgctgctccaatagacagcaataagattgtctctaatttgagcagtaacatgattgcaagagaccaagtttcacagcttgtaaagttctgtatttgggattcttgcttatttttccgcctgtgtttttctgagaacttattcctgatgatcaattgaatccagtagtttttctatgctatttgttgttgtataagctactgtaagaaacttatcataaggaaaaatagaaaggaaaacttgaatcaatactcattgattaaaatggaataaagaaagagcagctgccacttttaaacaacataaaggaatatctttttttgtctccgtgtaggaaatcccataagttcttatatttgttccagttcccatttcctgccattgaccagataacatcattgactttcaaatgacttttagaagtgataactcttaatttcctaatagatactagattgtattgaattctgttttaattattctctaggtaagtatgttttaggattaaataccttttacagatactgaaagtgcctccttttgtggtgtaaaaaacaaattatggtgcaaaaagtaatcactagattgaaatacatgaaggttttttgctttttgacatacgaaaatgtcaagagaaaggccaaagatttgtactttttcacttacaaagcactcctttttcccttaaacttctttctgtcaaattagatttaatgagagagtactatttttaaggagctatctgtttatgtagaatgattttgttaagagtaatgtaaactattattgagtagaggcctaaagaggactgtgcatttttgctatttaaaggaatcacaaatgatcatacttaagtgagcaaaaatgacaagttttactagctaagtagagaaataaatctcaaatgcagcgctacaattttcattatcttaagtacattgtacatttctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgtttgttttctttgttttttcccccttctcctgaatcagcagggatggaaggagggtagggaagttatgaattactccttccagtagtagctctgaagtgtcacatttaatatcagttttttttaaacatgattctagttaaatgtagaagagagaagaaagaggaagtgttcacttttttaatacactgatttagaaatttgatgtcttatatcagtagttctgaggtattgatagcttgctttatttctgcctttacgttgacagtgttgaagcagggtgaataactagggcatatatttttttttttggtaagctgtttcatgatgttttcttgggaatttccggataagttcaggaaaacattctgcatgttgtatctagtctgatgtacttatccatctcattacaaacaaaaacacacagactgcatttgtagctctgtaatccttgaatacggaagtaaattttcttctttcctgactttgacattgtagctatactgtttccatttttgtttttacaaatcctttgggtctaattctgtgagcctacctatagcactggattaaaatgtctgcatcatttctttagttatccagttaactttaaaactgttgtaaaagtgtaaaccagcccatgacaggtttttgtacatgttaaagaacttcattgttcagttttcatgattattgtgtaaggaagactgatgtagatgttctgtgctgtcctggaccatgttaattacacttacgacgtattttagttccacatcacaatgatttgtccccagtgacccttttatcctttctaggcacatttcttgttgttgttgttgttgcagttcccctttgcattgtattgctttgacaactgtaatttgaatcagatctgaaagaggtccagaataaaatatattttgatattaaaaaaaaaaaaaaaaaaaaaaaaaaaaaaaaaaaaaaaaaaaaaaaaaaaaacacagtgtgtgtggggccgcgccacagggcccacaagaaagacacttcaaaaacacacaggggtgggacgcggaggacccccaaaagagaaagcgaaacaggggcacaaagagcgcacccaagagaaacaccggggcagagacaacaggaggcgaggggtctcacacacaaaaaaaaaaaacggcacgggggagacacacgagaggtgttgtgaaaacgacacccacaagagggatacacagaagagaaaagacgggggaaccacataacaaggagagatccaaggagaccagcaaaataaataccg

SEQ ID NO: 290980 - DNA, 907 bp, Homo sapiens
tgggaattgtctgtatcagacatcatgggagcagatccagggcgacatcaaagggaagcatgagtctccaggaccagaggggcttggatgcagatgatcatcatctgggcactgctggatactgaggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaagtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatagaaaaaaaaaa

SEQ ID NO: 290981 - DNA, 727 bp, Homo sapiens
ttgtcttagtgtgtccggaattggtgggttcttggtctcactgagttctagaatgaagctgcagaccctcgcagtgagtgttacagctcttaagttctggtcagcctatgtgccatgccagacccaggaccgggatgccctgcgcctcaccctggagcagattgacctcatacgccgcatgtgtgcctcctattctgagctggagcttgtgacctcggctaaaggtaggcaagttgatgggaagcgttaggaacttgattgagctactccagccctggaaagtaatcacctgacctacctgcccccagctctgaacgacactcagaaattggcctgcctcatcggtgtagagggtggccactcgctggacaatagcctctccatcttacgtaccttctacatgctgggagtgcgctacctgacgctcacccacacctgcaacacaccctgctggtgagcctagtgcagatggtgtgggaccgctgaggcaggggcagagatctgcctgaggtcactgtgggcccagaacaagctttacccatgggatgtggcactgactctggagtggggaggggagctgggattctggttttcagaatacgacttgacccctggccagacgcggtggctcatgcctgtaatcccaaaactttgggaggctgaggcggacagataacttaaggccaggagttcgagaccagcctggccaagatggtgaaaccctatc

SEQ ID NO: 290982 - DNA, 1719 bp, Homo sapiens
ttgtcttagtgtgtccggaattggtgggttcttggtctcactgagttctagaatgaagctgcagaccctcgcagtgagtgttacagctcttaaggctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacggccagaccagcctggacaggcttagagatggcctcgtgggcgcccagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatagaaaaaaaaaa

SEQ ID NO: 290983 - DNA, 1698 bp, Homo sapiens
ttgtcttagtgtgtccggaattggtgggttcttggtctcactgagttctagaatgaagctgcagaccctcgcagctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacggccagaccagcctggacaggcttagagatggcctcgtgggcgcccagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatagaaaaaaaaaa

SEQ ID NO: 290984 - DNA, 1753 bp, Homo sapiens
ggtttctgtgagagctcaagccacaggagccacaagataagaggagtgtggctgcagaacccaggtggcagggctttcctcaggccccttactcctgacctggacgaggccggggcttcctcaaggaggctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacggccagaccagcctggacaggcttagagatggcctcgtgggcgcccagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatagaaaaaaaaaa

SEQ ID NO: 290985 - DNA, 1750 bp, Homo sapiens
tgggaattgtctgtatcagacatcatgggagcagatccagggcgacatcaaagggaagcatgagtctccaggaccagaggggcttggatgcagatgatcatcatctgggcactgctggatactgagctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacggccagaccagcctggacaggcttagagatggcctcgtgggcgcccagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatagaaaaaaaaaa

SEQ ID NO: 290986 - DNA, 1486 bp, Homo sapiens
tgggaattgtctgtatcagacatcatgggagcagatccagggcgacatcaaagggaagcatgagtctccaggaccagaggggcttggatgcagatgatcatcatctgggcactgctggatactgagctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatagaaaaaaaaaa

SEQ ID NO: 290987 - DNA, 1737 bp, Homo sapiens
ttgtcttagtgtgtccggaattggtgggttcttggtctcactgagttctagaatgaagctgcagaccctcgcagctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacggccagaccagcctggacaggcttagagatggcctcgtgggcgcccagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaggaatcaggtctgaaacccactagctggtggccacacagattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatagaaaaaaaaaa

SEQ ID NO: 290988 - DNA, 1043 bp, Homo sapiens
tgggaattgtctgtatcagacatcatgggagcagatccagggcgacatcaaagggaagcatgagtctccaggaccagaggggcttggatgcagatgatcatcatctgggcactgctggatactgaggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatagaaaaaaaaaa

SEQ ID NO: 290989 - DNA, 1562 bp, Homo sapiens
ttgtcttagtgtgtccggaattggtgggttcttggtctcactgagttctagaatgaagctgcagaccctcgcagctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacggccagaccagcctggacaggcttagagatggcctcgtgggcgcccagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaagtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatagaaaaaaaaaa

SEQ ID NO: 290990 - DNA, 1634 bp, Homo sapiens
ttgtcttagtgtgtccggaattggtgggttcttggtctcactgagttctagaatgaagctgcagaccctcgcagctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacggccagaccagcctggacaggcttagagatggcctcgtgggcgcccagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatagaaaaaaaaaa

SEQ ID NO: 290991 - DNA, 431 bp, Homo sapiens
taggggggatcatttgcattcagtaaaaggcatagatcttaatagtatgattcaataagttttgataaatattcaaggaggttttgaggcctccttctgaaggataaagagcagaggagaattacctactctctccaagtctccacttcccatacctgaccagggctggggtttcatagaccctggactgtggttctgagtcatgatcagggaatcaggtctgaaacccactagctggtggccacacagattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtactctgggctgggcaagagagtagccgaggggtctgagcaagtg

SEQ ID NO: 290992 - DNA, 5375 bp, Homo sapiens
  misc_feature (32)..(32): n is a, c, g, or t
ctaagctagggctgggctgttgcgcttgcgcncagggttcgcaatgcacgtcaacgcgcatgccgaccgcttccggtgcgccgcgagggccgccgggacggtctccctggcgatccgtggtgtgccgctactgccggtgcagccgccaaaccggtgcctcggtgacgaccgtgtccctgccgtcttcctcgagctccccggggcttgacccccggggccctcggcaggcatcggtgaggagcctgcggagcgaacctgtgctcctattcttgcccttcaggaccccatatcgcgactccgaggaggggaagcgagaggggctgtcgcgactccgcgccgtgtgtcgccgggcggggccgcggggccggggctccttcagcccccgggatgcgcgcgcgagccctcgcctccacttccttgttgctgctgtcacgactggagccgcctctcgccgacagcggggagcgcgagtgcgccagccatccccctcgtccagccgccgggccaagcgcctccgggaatgtgagcggcgcagcttgcacgctcctccggccatggacgcatcatatgatggtactgaggtaactgtcgtgatggaggaaattgaggaagcctattgttacacctctcctgggccacccaagaagaagaaaaagtataaaatacatggagaaaagacaaagaaacccaggtctgcttaccttctgtactattacgacatctacctgaaagtgcagcaggagctcccccacctccctcagtctgagatcaataagaagattagtgagagttggaggcttctcagcgtggccgagaggagttactacttggagaaagccaaactagagaaggaaggtttggatcctaactctaagctctctgcactgactgctgtggttccggacatcccaggtttccgcaagatcctcccacgctcagattatatcatcatccccaagagcagcctgcaggaggaccggagctgccctcagctagagctatgtgtggctcagaaccagatgtccccgaaaggacctcctcttgtgtccaacactgccccggagacagtgcccagccatgcaggcatggcagagcagtgcctggctgtggaggccctggctgaggaggtgggagcccttacccagtcaggtgctgtacaggagattgccacctcagagatcctcagccaggatgtgctcctagaggacgcttccctagaagtaggggagagccaccaaccttaccagacaagcctggtaattgaagagaccttggtgaatggctcaccagacctccccactggaagcctggctgtgccccacccccaggttggggagagtgtatcagtggtaacagtcatgagggattccagtgagagtagctcctctgcaccagccacacagttcatcatgttgcctctgcctgcctactcggttgtggagaaccccacctccatcaaactgaccactacatatacccgccggggccatgggacatgcaccagcccagggtgctcctttacatatgtcaccaggcacaagccacctaagtgccctacctgtggtaacttcctaggagggaagtggatcccaaaggaaaagccagccaaagtaaaagtggaattggcttctggcgtctcttccaaaggctctgtggtgaaaagaaatcagcaacctgtcaccactgagcaaaattcctctaaggaaaatgcctccaaactgactctggagaattcggaagctgtaagccagctcctgaacgtagctcctcccagagaagtaggtgaggagagtgagtgggaggaagtgatcatctccgatgcccatgttttggttaaggaagctcccgggaattgtggtacagcagtcactaagacgccagtcgtcaaaagtggtgtgcagcctgaggtcactctggggacaactgacaatgacagtcctggagcagacgtaccaacaccatccgaggggacaagtacctccagtccactccctgctcctaaaaaacctacaggagttgacctgcttacccctgggtccagagctccagagcttaaaggcagagcacggggcaagccctcattactggctgcagcaagacccatgagagcaattttgccagccccagttaacgtggggcgaggcagcagcatgggactgcccagggccaggcaggccttttccctgagtgataagactccctctgtgaggacttgtggtctgaagccaagcacactgaagcagctgggccagcccattcaacagccatctggccctggtgaggtgaagctaccaagtggcccatccaacaggacttctcaggtgaaagttgtggaggtcaagcccgatatgtttcctccatataagtacagctgcactgtcacattggatttgggcctggctacatcaagaggccggggaaagtgcaagaatccctcttgtagctatgtctacaccaacaggcacaaacctcgaatttgtcccagctgtggtgttaaccttgccaaagaccggactgagaaaaccaccaaggctatcgaggtgagctcaccactcccagatgtactgaatgccacagagcccctgagcacagcccagagggagatccagcgccagtccacactgcagctgctgcgcaaagtcctgcagattcctgagaatgagtcagagctggctgaggtcttcgccttgattcatgaactcaacagctctcgacttatcttgtccaacgtgagtgaggagacagtcaccatcgagcaaacctcttggtcgaattattatgagtctccgtccacgcagtgccttctctgtagcagcccattattcaaagggggacaaaactccctggctgggccccaggagtgctggctgctgacagccagccgtctgcagacagtgactgcccaggtgaagatgtgtctgaacccccattgtctggccctgcacagcttcatagacatctacacaggtctctttaatgtggggaacaagctgctggtaagcctggacttgctttttgcaatcagaaatcagatcaagctcggagaggaccccagagtgtccatcaatgttgttctgaagtcggtgcaggagcagacagagaagactctgacctcggaggagctgagccagctgcaggagctgctgtgcaatggctattgggcctttgagtgcctcactgtccgagactacaatgacatgatctgtggcatctgtggtgtggcccccaaagtggaaatggctcagaggagtgaagagaatgtgctagcactgaagagcgtggagttcacctggcctgaattcctgggctctaatgaggtaaatgtggaggacttttgggccacgatggagacagaggtgattgagcaggtggcatttcctgccagcatccctatcaccaaatttgatgcgtctgttattgcccccttcttcccaccactcatgagaggagctgtggtcgtcaacactgagaaagacaaaaacctggatgtgcagccagtacctggcagtggcagtgccttggtgaggctgctccaggagggcacctgcaagcttgatgagattggctcctacagtgaagagaagctgcagcacctgctaaggcagtgtggaatcccctttggggcagaagactccaaggaccagctctgcttctccttgttggccctctacgaatctgtacagaatggagctagagctatacggcccccacgtcacttcacaggtggtaaaatctacaaggtgtgcccccatcaggtggtctgcggctccaagtatcttgtgcgaggtgagagtgcccgtgaccatgtggacctgcttgcctcttcccgccactggccgcctgtctatgtggtagatatggccacgtcagtggccctgtgtgctgacctctgctacccagagctgactaaccagatgtgggggaggaaccagggctgtttctctagccccacagagccacctgtgagtgtgtcctgcccagagctcttggaccagcattatactgtggacatgacagaaactgagcactctatccagcacccagtcaccaagactgccacgcggcgcatcgtccatgcaggcctacagcccaatcctggtgaccccagtgctgggcaccactccttggccctgtgccctgaattggcaccttacgcaaccatcctggcctccatcgtggacagcaaaccaaacggtgtccgccagcggcccattgccttcgacaatgccactcactattacctctacaaccgcctcatggacttcctcaccagccgcgaaattgtcaatcgtcagatccatgacattgtacagagctgccagcctggtgaggtggtcattcgtgacaccctctaccgccttggggttgctcagatcaagacagagacagaggaggagggtgaggaagaggaggtggccgcagtggcagaataagccaggctgttgtacagggactacaccatctctcaagccatagtaaggcccttgcctgaggcagagctatccaggggacctgcagaagtggtctcctgtggggagggcctctgactgctgggactgaccaaagagcttccattccctgagcatggtgggacccagggtcctcagttctcaaccctccaggggtcaggagtggtaccaggaaacctcttctggccccgagagagcacttgggggacacggtatgtttaatggaggggaggctgagggaaaggctgatagctggtgggttccgtggggcctgctgtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctgaaggagggatgcatttctctcttgctcttcctgtacccacatttgggggaagctgaggagggaggaacagtcagccacagctctcttccagcactgtcctctccaccccaagctttgaggaagagcatccccttcctcctttccctggccactgctgctgcagccaatatcctctctgggcctgggaccctctccacagaggggatgtggtccctggtcatgacataacctagcagcagtaggaaaaactcccttctatgaaggggaagcagactgggccataaggaaacagcaggactggctcaagtgcccaaggtttgtttagggcctgggaattggccatgtgttaatttattgagtggagtaggtggctttttttccctccctcttcccccaacaagaataaagtttattaaattatctggt

SEQ ID NO: 290993 - DNA, 785 bp, Homo sapiens
tgcagctggatgcatagaaggaatgttgggccaagaatagagaaatatgggttctaggtctagctctgcccttgattgatgatttgaggcaaagcatttaaacctcagtagtaataatacgtacttaatacgattgctgagagtattaaatgaaatattggtaaagtgtttagcattgtgtggtgcctagctcaatgcatagcaactatcactttcttcattcttctggtacctaactgtaatgttgggcaattgtctttccccatttgaacttagtttctccatttctaaagagtgaatttgttgtattgtaggacctttccaacactgaccttttatgatatgattatgaattggttatctttccacaagcttgtgacctcctggtgttgctgtgattatagtggtcatcagtctgagagaggttgttctattgattctgatgtgctctttatttacagaccactacatatacccgccggggccatgggacatgcaccagcccagggtgctcctttacatatgtcaccaggcacaagccacctaagtgccctacctgtggtaacttcctaggagggaagtggatcccaaaggtaaggtccattggctgttgctgctttggaagcctcacagaatagactttctgtttgccattaggaacaggtgatttttaaaaagttaacatttgtttttactgtctgactatacaagtaaatcatttccattgtatatagtttgtttaaaaaatacaaaagaaaaatggaataaattgttatccaaactca

SEQ ID NO: 290994 - DNA, 111 bp, Homo sapiens
tcaagcttctaacgatgtacggggacatgtgttaatttattgagtggagtaggtggctttttttccctccctcttcccccaacaagaataaagtttattaaattatctggt

SEQ ID NO: 290995 - DNA, 4373 bp, Homo sapiens
tgcagctggatgcatagaaggaatgttgggccaagaatagagaaatatgggttctaggtctagctctgcccttgattgatgatttgaggcaaagcatttaaacctcagtagtaataatacgtacttaatacgattgctgagagtattaaatgaaatattggtaaagtgtttagcattgtgtggtgcctagctcaatgcatagcaactatcactttcttcattcttctggtacctaactgtaatgttgggcaattgtctttccccatttgaacttagtttctccatttctaaagagtgaatttgttgtattgtaggacctttccaacactgaccttttatgatatgattatgaattggttatctttccacaagcttgtgacctcctggtgttgctgtgattatagtggtcatcagtctgagagaggttgttctattgattctgatgtgctctttatttacagaccactacatatacccgccggggccatgggacatgcaccagcccagggtgctcctttacatatgtcaccaggcacaagccacctaagtgccctacctgtggtaacttcctaggagggaagtggatcccaaaggaaaagccagccaaagtaaaagtggaattggcttctggcgtctcttccaaaggctctgtggtgaaaagaaatcagcaacctgtcaccactgagcaaaattcctctaaggaaaatgcctccaaactgactctggagaattcggaagctgtaagccagctcctgaacgtagctcctcccagagaagtaggtgaggagagtgagtgggaggaagtgatcatctccgatgcccatgttttggttaaggaagctcccgggaattgtggtacagcagtcactaagacgccagtcgtcaaaagtggtgtgcagcctgaggtcactctggggacaactgacaatgacagtcctggagcagacgtaccaacaccatccgaggggacaagtacctccagtccactccctgctcctaaaaaacctacaggagttgacctgcttacccctgggtccagagctccagagcttaaaggcagagcacggggcaagccctcattactggctgcagcaagacccatgagagcaattttgccagccccagttaacgtggggcgaggcagcagcatgggactgcccagggccaggcaggccttttccctgagtgataagactccctctgtgaggacttgtggtctgaagccaagcacactgaagcagctgggccagcccattcaacagccatctggccctggtgaggtgaagctaccaagtggcccatccaacaggacttctcaggtgaaagttgtggaggtcaagcccgatatgtttcctccatataagtacagctgcactgtcacattggatttgggcctggctacatcaagaggccggggaaagtgcaagaatccctcttgtagctatgtctacaccaacaggcacaaacctcgaatttgtcccagctgtggtgttaaccttgccaaagaccggactgagaaaaccaccaaggctatcgaggtgagctcaccactcccagatgtactgaatgccacagagcccctgagcacagcccagagggagatccagcgccagtccacactgcagctgctgcgcaaagtcctgcagattcctgagaatgagtcagagctggctgaggtcttcgccttgattcatgaactcaacagctctcgacttatcttgtccaacgtgagtgaggagacagtcaccatcgagcaaacctcttggtcgaattattatgagtctccgtccacgcagtgccttctctgtagcagcccattattcaaagggggacaaaactccctggctgggccccaggagtgctggctgctgacagccagccgtctgcagacagtgactgcccaggtgaagatgtgtctgaacccccattgtctggccctgcacagcttcatagacatctacacaggtctctttaatgtggggaacaagctgctggtaagcctggacttgctttttgcaatcagaaatcagatcaagctcggagaggaccccagagtgtccatcaatgttgttctgaagtcggtgcaggagcagacagagaagactctgacctcggaggagctgagccagctgcaggagctgctgtgcaatggctattgggcctttgagtgcctcactgtccgagactacaatgacatgatctgtggcatctgtggtgtggcccccaaagtggaaatggctcagaggagtgaagagaatgtgctagcactgaagagcgtggagttcacctggcctgaattcctgggctctaatgaggtaaatgtggaggacttttgggccacgatggagacagaggtgattgagcaggtggcatttcctgccagcatccctatcaccaaatttgatgcgtctgttattgcccccttcttcccaccactcatgagaggagctgtggtcgtcaacactgagaaagacaaaaacctggatgtgcagccagtacctggcagtggcagtgccttggtgaggctgctccaggagggcacctgcaagcttgatgagattggctcctacagtgaagagaagctgcagcacctgctaaggcagtgtggaatcccctttggggcagaagactccaaggaccagctctgcttctccttgttggccctctacgaatctgtacagaatggagctagagctatacggcccccacgtcacttcacaggtggtaaaatctacaaggtgtgcccccatcaggtggtctgcggctccaagtatcttgtgcgaggtgagagtgcccgtgaccatgtggacctgcttgcctcttcccgccactggccgcctgtctatgtggtagatatggccacgtcagtggccctgtgtgctgacctctgctacccagagctgactaaccagatgtgggggaggaaccagggctgtttctctagccccacagagccacctgtgagtgtgtcctgcccagagctcttggaccagcattatactgtggacatgacagaaactgagcactctatccagcacccagtcaccaagactgccacgcggcgcatcgtccatgcaggcctacagcccaatcctggtgaccccagtgctgggcaccactccttggccctgtgccctgaattggcaccttacgcaaccatcctggcctccatcgtggacagcaaaccaaacggtgtccgccagcggcccattgccttcgacaatgccactcactattacctctacaaccgcctcatggacttcctcaccagccgcgaaattgtcaatcgtcagatccatgacattgtacagagctgccagcctggtgaggtggtcattcgtgacaccctctaccgccttggggttgctcagatcaagacagagacagaggaggagggtgaggaagaggaggtggccgcagtggcagaataagccaggctgttgtacagggactacaccatctctcaagccatagtaaggcccttgcctgaggcagagctatccaggggacctgcagaagtggtctcctgtggggagggcctctgactgctgggactgaccaaagagcttccattccctgagcatggtgggacccagggtcctcagttctcaaccctccaggggtcaggagtggtaccaggaaacctcttctggccccgagagagcacttgggggacacggtatgtttaatggaggggaggctgagggaaaggctgatagctggtgggttccgtggggcctgctgtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctgaaggagggatgcatttctctcttgctcttcctgtacccacatttgggggaagctgaggagggaggaacagtcagccacagctctcttccagcactgtcctctccaccccaagctttgaggaagagcatccccttcctcctttccctggccactgctgctgcagccaatatcctctctgggcctgggaccctctccacagaggggatgtggtccctggtcatgacataacctagcagcagtaggaaaaactcccttctatgaaggggaagcagactgggccataaggaaacagcaggactggctcaagtgcccaaggtttgtttagggcctgggaattggccatgtgttaatttattgagtggagtaggtggctttttttccctccctcttcccccaacaagaataaagtttattaaattatctggt

SEQ ID NO: 290996 - DNA, 3948 bp, Homo sapiens
cacgaggggaaggtatctggttagcgtcggtagttttgtatatttccagcccctagattcccttcatgtacactctgttacttgggtaaaccccagtcttctctgtaaatagtttccttttgattggtgacattgggtatttgttaaaagccacaagctcttttactagtcttaaaccagtaaagaggtacatgagatattcagaaaatcaacttaaattcattattatagaataattttaattttgtatgctttatcttttcttttttttagctatataagtaaaatatacattccttataaaacatttgaggccaggcatggtggctcatgcctgtaatcccagcactttgggaggctgaggtgggagcattgcttgagtccagcagttcaagaccagcctgggcaacatagtgagacccacatcgctaccaaaaaaaaagcaaatttggtagatagtggtaaagagggagaaacaaccatgattgtcctcttaccctgtgacattttagtgaatagtctttcagacatctttctatgcaaagttgttcaaccatgtatttatatgtataaaagctattatgtgcttttataactcagtagtagttgtaaatctgattcatggtgtttctaatacatggtattagaaactgcacagaagcatgtggcaaggcctggacttgaacatgacactcagcctttggtgggcttgtgactgccaactggcagtccagagggctcatttggagaatagctctacaaattccccgggaaagcattccctcaagtcgtttcaggacatgggagctcaggagtttggctaaggttcaaaagcactaaataatttgttctgatccacagctaccaagtggcccatccaacaggacttctcaggtgaaagttgtggaggtcaagcccgatatgtttcctccatataagtacagctgcactgtcacattggatttgggcctggctacatcaagaggccggggaaagtgcaagaatccctcttgtagctatgtctacaccaacaggcacaaacctcgaatttgtcccagctgtggtgttaaccttgccaaagaccggactgagaaaaccaccaaggctatcgaggtgagctcaccactcccagatgtactgaatgccacagagcccctgagcacagcccagagggagatccagcgccagtccacactgcagctgctgcgcaaagtcctgcagattcctgagaatgagtcagagctggctgaggtcttcgccttgattcatgaactcaacagctctcgacttatcttgtccaacgtgagtgaggagacagtcaccatcgagcaaacctcttggtcgaattattatgagtctccgtccacgcagtgccttctctgtagcagcccattattcaaagggggacaaaactccctggctgggccccaggagtgctggctgctgacagccagccgtctgcagacagtgactgcccaggtgaagatgtgtctgaacccccattgtctggccctgcacagcttcatagacatctacacaggtctctttaatgtggggaacaagctgctggtaagcctggacttgctttttgcaatcagaaatcagatcaagctcggagaggaccccagagtgtccatcaatgttgttctgaagtcggtgcaggagcagacagagaagactctgacctcggaggagctgagccagctgcaggagctgctgtgcaatggctattgggcctttgagtgcctcactgtccgagactacaatgacatgatctgtggcatctgtggtgtggcccccaaagtggaaatggctcagaggagtgaagagaatgtgctagcactgaagagcgtggagttcacctggcctgaattcctgggctctaatgaggtaaatgtggaggacttttgggccacgatggagacagaggtgattgagcaggtggcatttcctgccagcatccctatcaccaaatttgatgcgtctgttattgcccccttcttcccaccactcatgagaggagctgtggtcgtcaacactgagaaagacaaaaacctggatgtgcagccagtacctggcagtggcagtgccttggtgaggctgctccaggagggcacctgcaagcttgatgagattggctcctacagtgaagagaagctgcagcacctgctaaggcagtgtggaatcccctttggggcagaagactccaaggaccagctctgcttctccttgttggccctctacgaatctgtacagaatggagctagagctatacggcccccacgtcacttcacaggtggtaaaatctacaaggtgtgcccccatcaggtggtctgcggctccaagtatcttgtgcgaggtgagagtgcccgtgaccatgtggacctgcttgcctcttcccgccactggccgcctgtctatgtggtagatatggccacgtcagtggccctgtgtgctgacctctgctacccagagctgactaaccagatgtgggggaggaaccagggctgtttctctagccccacagagccacctgtgagtgtgtcctgcccagagctcttggaccagcattatactgtggacatgacagaaactgagcactctatccagcacccagtcaccaagactgccacgcggcgcatcgtccatgcaggcctacagcccaatcctggtgaccccagtgctgggcaccactccttggccctgtgccctgaattggcaccttacgcaaccatcctggcctccatcgtggacagcaaaccaaacggtgtccgccagcggcccattgccttcgacaatgccactcactattacctctacaaccgcctcatggacttcctcaccagccgcgaaattgtcaatcgtcagatccatgacattgtacagagctgccagcctggtgaggtggtcattcgtgacaccctctaccgccttggggttgctcagatcaagacagagacagaggaggagggtgaggaagaggaggtggccgcagtggcagaataagccaggctgttgtacagggactacaccatctctcaagccatagtaaggcccttgcctgaggcagagctatccaggggacctgcagaagtggtctcctgtggggagggcctctgactgctgggactgaccaaagagcttccattccctgagcatggtgggacccagggtcctcagttctcaaccctccaggggtcaggagtggtaccaggaaacctcttctggccccgagagagcacttgggggacacggtatgtttaatggaggggaggctgagggaaaggctgatagctggtgggttccgtggggcctgctgtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctgaaggagggatgcatttctctcttgctcttcctgtacccacatttgggggaagctgaggagggaggaacagtcagccacagctctcttccagcactgtcctctccaccccaagctttgaggaagagcatccccttcctcctttccctggccactgctgctgcagccaatatcctctctgggcctgggaccctctccacagaggggatgtggtccctggtcatgacataacctagcagcagtaggaaaaactcccttctatgaaggggaagcagactgggccataaggaaacagcaggactggctcaagtgcccaaggtttgtttagggcctgggaattggccatgtgttaatttattgagtggagtaggtggctttttttccctccctcttcccccaacaagaataaagtttattaaattatctggt

SEQ ID NO: 290997 - DNA, 5159 bp, Homo sapiens
  misc_feature (32)..(32): n is a, c, g, or t
ctaagctagggctgggctgttgcgcttgcgcncagggttcgcaatgcacgtcaacgcgcatgccgaccgcttccggtgcgccgcgagggccgccgggacggtctccctggcgatccgtggtgtgccgctactgccggtgcagccgccaaaccggtgcctcggtgacgaccgtgtccctgccgtcttcctcgagctccccggggcttgacccccggggccctcggcaggcatcggtgaggagcctgcggagcgaacctgtgctcctattcttgcccttcaggaccccatatcgcgactccgaggaggggaagcgagaggggctgtcgcgactccgcgccgtgtgtcgccgggcggggccgcggggccggggctccttcagcccccgggatgcgcgcgcgagccctcgcctccacttccttgttgctgctgtcacgactggagccgcctctcgccgacagcggggagcgcgagtgcgccagccatccccctcgtccagccgccgggccaagcgcctccgggaatgtgagcggcgcagcttgcacgctcctccggccatggacgcatcatatgatggtactgaggtaactgtcgtgatggaggaaattgaggaagcctattgttacacctctcctgggccacccaagaagaagaaaaagtataaaatacatggagaaaagacaaagaaacccaggtctgcttaccttctgtactattacgacatctacctgaaagtgcagcaggagctcccccacctccctcagtctgagatcaataagaagattagtgagagttggaggcttctcagcgtggccgagaggagttactacttggagaaagccaaactagagaaggaaggtttggatcctaactctaagctctctgcactgactgctgtggttccggacatcccaggtttccgcaagatcctcccacgctcagattatatcatcatccccaagagcagcctgcaggaggaccggagctgccctcagctagagctatgtgtggctcagaaccagatgtccccgaaaggacctcctcttgtgtccaacactgccccggagacagtgcccagccatgcaggcatggcagagcagtgcctggctgtggaggccctggctgaggaggtgggagcccttacccagtcaggtgctgtacaggagattgccacctcagagatcctcagccaggatgtgctcctagaggacgcttccctagaagtaggggagagccaccaaccttaccagacaagcctggtaattgaagagaccttggtgaatggctcaccagacctccccactggaagcctggctgtgccccacccccaggttggggagagtgtatcagtggtaacagtcatgagggattccagtgagagtagctcctctgcaccagccacacagttcatcatgttgcctctgcctgcctactcggttgtggagaaccccacctccatcaaactgaccactacatatacccgccggggccatgggacatgcaccagcccagggtgctcctttacatatgtcaccaggcacaagccacctaagtgccctacctgtggtaacttcctaggagggaagtggatcccaaaggaaaagccagccaaagtaaaagtggaattggcttctggcgtctcttccaaaggctctgtggtgaaaagaaatcagcaacctgtcaccactgagcaaaattcctctaaggaaaatgcctccaaactgactctggagaattcggaagctgtaagccagctcctgaacgtagctcctcccagagaagtaggtgaggagagtgagtgggaggaagtgatcatctccgatgcccatgttttggttaaggaagctcccgggaattgtggtacagcagtcactaagacgccagtcgtcaaaagtggtgtgcagcctgaggtcactctggggacaactgacaatgacagtcctggagcagacgtaccaacaccatccgaggggacaagtacctccagtccactccctgctcctaaaaaacctacaggagttgacctgcttacccctgggtccagagctccagagcttaaaggcagagcacggggcaagccctcattactggctgcagcaagacccatgagagcaattttgccagccccagttaacgtggggcgaggcagcagcatgggactgcccagggccaggcaggccttttccctgagtgataagactccctctgtgaggacttgtggtctgaagccaagcacactgaagcagctgggccagcccattcaacagccatctggccctggtgaggtgaagctaccaagtggcccatccaacaggacttctcaggtgaaagttgtggaggtcaagcccgatatgtttcctccatataagtacagctgcactgtcacattggatttgggcctggctacatcaagaggccggggaaagtgcaagaatccctcttgtagctatgtctacaccaacaggcacaaacctcgaatttgtcccagctgtggtgttaaccttgccaaagaccggactgagaaaaccaccaaggctatcgaggtgagctcaccactcccagatgtactgaatgccacagagcccctgagcacagcccagagggagatccagcgccagtccacactgcagctgctgcgcaaagtcctgcagattcctgagaatgagtcagagctggctgaggtcttcgccttgattcatgaactcaacagctctcgacttatcttgtccaacgtgagtgaggagacagtcaccatcgagcaaacctcttggtcgaattattatgagtctccgtccacgcagtgccttctctgtagcagcccattattcaaagggggacaaaactccctggctgggccccaggagtgctggctgctgacagccagccgtctgcagacagtgactgcccaggtgaagatgtgtctgaacccccattgtctggccctgcacagcttcatagacatctacacaggtctctttaatgtggggaacaagctgctggtaagcctggacttgctttttgcaatcagaaatcagatcaagctcggagaggaccccagagtgtccatcaatgttgttctgaagtcggtgcaggagcagacagagaagactctgacctcggaggagctgagccagctgcaggagctgctgtgcaatggctattgggcctttgagtgcctcactgtccgagactacaatgacatgatctgtggcatctgtggtgtggcccccaaagtggaaatggctcagaggagtgaagagaatgtgctagcactgaagagcgtggagttcacctggcctgaattcctgggctctaatgaggtaaatgtggaggacttttgggccacgatggagacagaggtgattgagcaggtggcatttcctgccagcatccctatcaccaaatttgatgcgtctgttattgcccccttcttcccaccactcatgagaggagctgtggtcgtcaacactgagaaagacaaaaacctggatgtgcagccagtacctggcagtggcagtgccttggtgaggctgctccaggagggcacctgcaagcttgatgagattggctcctacagtgaagagaagctgcagcacctgctaaggcagtgtggaatcccctttggggcagaagactccaaggaccagctctgcttctccttgttggccctctacgaatctgtacagaatggagctagagctatacggcccccacgtcacttcacaggtggtaaaatctacaaggtgtgcccccatcaggtggtctgcggctccaagtatcttgtgcgaggtgagagtgcccgtgaccatgtggacctgcttgcctcttcccgccactggccgcctgtctatgtggtagatatggccacgtcagtggccctgtgtgctgacctctgctacccagagctgactaaccagatgtgggggaggaaccagggctgtttctctagccccacagagccacctgtgagtgtgtcctgcccagagctcttggaccagcattatactgtggacatgacagaaactgagcactctatccagcacccagtcaccaagactgccacgcggcgcatcgtccatgcaggcctacagcccaatcctggtgaccccagtgctgggcaccactccttggccctgtgccctgaattggcaccttacgcaaccatcctggcctccatcgtggacagcaaaccaaacggtgtccgccagcggcccattgccttcgacaatgccactcactattacctctacaaccgcctcatggacttcctcaccagccgcgaaattgtcaatcgtcagatccatgacattgtacagagctgccagcctggtgaggtggtcattcgtgacaccctctaccgccttggggttgctcagatcaagacagagacagaggaggagggtgaggaagaggaggtggccgcagtggcagaataagccaggctgttgtacagggactacaccatctctcaagccatagtaaggcccttgcctgaggcagagctatccaggggacctgcagaagtggtctcctgtggggagggcctctgactgctgggactgaccaaagagcttccattccctgagcatggtgggacccagggtcctcagttctcaaccctccaggggtcaggagtggtaccaggaaacctcttctggccccgagagagcacttgggggacacggtatgtttaatggaggggaggctgagggaaaggctgatagctggtgggttccgtggggcctgctgtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctggtcatgacataacctagcagcagtaggaaaaactcccttctatgaaggggaagcagactgggccataaggaaacagcaggactggctcaagtgcccaaggtttgtttagggcctgggaattggccatgtgttaatttattgagtggagtaggtggctttttttccctccctcttcccccaacaagaataaagtttattaaattatctggt

SEQ ID NO: 290998 - DNA, 1923 bp, Homo sapiens
  misc_feature (12)..(12): n is a, c, g, or t
cagtacggatgncatggctctgggagccagcaagagtggacagctgtacctggcagtggcagtgccttggtgaggctgctccaggagggcacctgcaagcttgatgagattggctcctacagtgaagagaagctgcagcacctgctaaggcagtgtggaatcccctttggggcagaagactccaaggaccagctctgcttctccttgttggccctctacgaatctgtacagaatggagctagagctatacggcccccacgtcacttcacaggtggtaaaatctacaaggtgtgcccccatcaggtggtctgcggctccaagtatcttgtgcgaggtgagagtgcccgtgaccatgtggacctgcttgcctcttcccgccactggccgcctgtctatgtggtagatatggccacgtcagtggccctgtgtgctgacctctgctacccagagctgactaaccagatgtgggggaggaaccagggctgtttctctagccccacagagccacctgtgagtgtgtcctgcccagagctcttggaccagcattatactgtggacatgacagaaactgagcactctatccagcacccagtcaccaagactgccacgcggcgcatcgtccatgcaggcctacagcccaatcctggtgaccccagtgctgggcaccactccttggccctgtgccctgaattggcaccttacgcaaccatcctggcctccatcgtggacagcaaaccaaacggtgtccgccagcggcccattgccttcgacaatgccactcactattacctctacaaccgcctcatggacttcctcaccagccgcgaaattgtcaatcgtcagatccatgacattgtacagagctgccagcctggtgaggtggtcattcgtgacaccctctaccgccttggggttgctcagatcaagacagagacagaggaggagggtgaggaagaggaggtggccgcagtggcagaataagccaggctgttgtacagggactacaccatctctcaagccatagtaaggcccttgcctgaggcagagctatccaggggacctgcagaagtggtctcctgtggggagggcctctgactgctgggactgaccaaagagcttccattccctgagcatggtgggacccagggtcctcagttctcaaccctccaggggtcaggagtggtaccaggaaacctcttctggccccgagagagcacttgggggacacggtatgtttaatggaggggaggctgagggaaaggctgatagctggtgggttccgtggggcctgctgtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctgaaggagggatgcatttctctcttgctcttcctgtacccacatttgggggaagctgaggagggaggaacagtcagccacagctctcttccagcactgtcctctccaccccaagctttgaggaagagcatccccttcctcctttccctggccactgctgctgcagccaatatcctctctgggcctgggaccctctccacagaggggatgtggtccctggtcatgacataacctagcagcagtaggaaaaactcccttctatgaaggggaagcagactgggccataaggaaacagcaggactggctcaagtgcccaaggtttgtttagggcctgggaattggccatgtgttaatttattgagtggagtaggtggctttttttccctccctcttcccccaacaagaataaagtttattaaattatctggt

SEQ ID NO: 290999 - DNA, 443 bp, Homo sapiens
ctttttgcaatcagaaatcagatcaagctcggagaggaccccagagtgtccatcaatgttgttctgaagtcggtgcaggagcagacaggtaaaagttgttttcttccctttcccaaggttagtcctaagctccctcggaattttcagtgatggcatttggttaaaagactcattttgaagaagagtctgattattttgaaaaggagacattcttgacttcctaatacactcttccttttgaattttacaaatgccaaactaattttggaaagcatgaatctttttgtgcatccagggacccttagcaagagattacgagtgacttgtagaagtaccttctttggtcatagggagacttggccccattgcatgttagactcattctgaccacacagctcctggatatctgcttccagtcccaaggctcatgccaagacctaaga

SEQ ID NO: 291000 - DNA, 530 bp, Homo sapiens
caccacgttggccaggctggtcttgaactcctgacctcaggtgatccgcccgcctcggcctcccaaagtgctgggattacaggcgtgagccgccgtgcccggccgccactagcctgtttaaagcaggtaaatagggtgctgagaacacttgaaagggttagaattggattctctcactaactgcttatgtgatcttagaagtcctaaatgtcttagaacctcagttttctcatctataaaataaacatagcacacttcctgtggaaatagttttctctttgttcttaaactttttgagataatcataaattcattccttttgataagcacattgggatgagtacactgtctgttattaaacttaatccaggcttccagtgttgagtggcctgggtgttctttattactctgtttcagtgaaactgtccttctcttcattgcccataggattccagtgagagtagctcctctgcaccagccacacagttcatcatgttgcctctgcctgcctactcggttgtggagaaccc

SEQ ID NO: 291001 - DNA, 253 bp, Homo sapiens
atgagttgaacttacattccttacgggtggatggttatagaaaagggagctgggcttcccaagaaccacagcagcatgactcacagtcattgctgcctctcctgggaattattcgacccatctaggtaaaagcaaggtaacttatttttgccgcgttgtttacgcatcggtttctagtgttgactttgcaaagcacagagttctcagtgtgttatccttatgtgttattccagatcccaactgctccgccaag

SEQ ID NO: 291002 - DNA, 495 bp, Homo sapiens
tacagatgagtaaaaacaagaaattggtgcaaggtttgaaaggcagaaaggaggcagcagctgtgactggagagcgctacagtgtaaggtggtgagagacagctgcagaggcgctggtcggttggctttcatcttccgtctttcctgctgcatgcctggtgcttcttcctgccagctttactgaccaacagcaactccaaccccattaccgatgctcggctgcaagctcagaggtaatctcaccagggaagcaaagacccttccagacttcttcactagccccttccagggtttccactcctgcagctggacattcctaacttccaaatttccccaaagttcgaacttgtccacctgtgccagggcttgaagaggacgtgccttttttccccctaatttgagtggtaaagtctgaagactgaaaaacaactttcctttttaaaatgctaacttgttttcctagaatttgaacaatattcattcatacattacaaa

SEQ ID NO: 291003 - DNA, 457 bp, Homo sapiens
tacagatgagtaaaaacaagaaattggtgcaaggtttgaaaggcagaaaggaggcagcagctgtgactggagagcgctacagtgtaaggtggtgagagacagctgcagaggcgctggtcggttggctttcatcttccgtctttcctgctgcatgcctggtgcttcttcctgccagctttactgaccaacagcaactccaaccccattaccgatgctcggctgcaagctcagagaatgaatgggttcacacagcaaccctgtcaaagaggtactatgatccagatttcacaaagcagaatataattattaagtaacttctcggagatcacagtggaggaactaagattcaaattgtcttctgaccagagctgggctctgaaaccactccaagaattgatcatcagccttaaacaatcagttttctttccttgtaataaactgagttactcatctaaga

SEQ ID NO: 291004 - DNA, 1885 bp, Homo sapiens
cattgagtataccatccagcaaaggcaccacctattatccgctacttggggctccatccacccaggaggtccccaagccagggagtttccacaacgttgaacggcgcctctctttttaatcgctcccttggccccttgacaaaaaccggtacggtaacttggccctcacggaactttaaaccgccccctttttttttttgttatttgaaaatactggatttaatagaaaatatcacattgtaaacaaatccattgatccatgagcttaaaacagaatgacggcacaatcacatagaaaagctaaagacaaaatactggtaccaaacatagcccttaggcctgggctaggctctcaaaggtctttcccagaaatggaggcagcagtagcttcaaacaggcacaaaaacagccaggaggaggcagcatccactccatgaaggcctaagacaatgaaaggaagccagagcaacagaccaccttgggatccggggagaagggtaaatgggcaaaagggttgtatttcctgatgctctcagaacatcagaccacaccatgtgaatttaagcaggactattttaagtggggaaacaatactagaagcatttggtgtattttcctggcactcacctcctaggtaagcaggagagcgggacactcaggagttgtgactaaactcacacttaagctgcctgtccagaccgtccccttggctgaacacaacactgaaattgtggcagtgtctgttgccccagtggacctcccacttactaatgagtatgtaaaacagaggagccacagtgaggcctttcacaaaaacacagggctctgggggaaaaacggcttccaccttctgccttttggtgctggagagtccctgagggagagaagtttgacgtggctgggccccttgaggctctggatttatcaatagaagcctcctctttggccccacccacccaaatccacccccaggttctcctagttcagagaaaagctgtgaaagtggaagaaggaagggatcgttttctttccattgcacttgttactgaccaaagagactgcttccttgcacttattttagatattgagagtttgtgccttcacttggaacaatggttctcaaccaaggggcaggcctgtgcaagaaggactctcaagaggtggtatccaatatacataagcccctaattccctcccacttgaaaatcagtgcgtgtaaggagagaaattcctgacgggagtgtgtcatatgtgtgaaccatggctgaagcagaacaaaaagtttaaaactcccaacctgggtttggcagacatcaaaatgatggagtacattttgcagatattttttttctgattaagttacaaacattctccctatagctaaactccgtgactaggctcccagcctcatggccaagaacaataagttcacccacttatctggagtaaccatactagattaaagaaatacaattctttcttctaaagacaatttccagaaagacctgcctttccctatgggtacttgacactaggtcccagcacaggctaatcgctgtatggtttcttcgaagattggcttttctcagtttctttctctttgatactgtacaaggggtccaccaacttgttatgaacaagcattaaacctacaaaaaattaaaaacaaaaagtagttaattcaggcagtggcaagagttccttgattatcaatcataacatccaggagctctcaaattttgtcttagagctgacacttctctcttttctctatgatccccaaatgataaacaccctaagagtacaaaaagagttattcacagtgagtactacattcatggaacttttataaattcaatcactatgggagttggctatttaaagg

SEQ ID NO: 291005 - DNA, 1221 bp, Homo sapiens
cattgagtataccatccagcaaaggcaccacctattatccgctacttggggctccatccacccaggaggtccccaagccagggagtttccacaacgttgaacggcgcctctctttttaatcgctcccttggccccttgacaaaaaccggtacggtaacttggccctcacggaactttaaaccgccccctttttttttttgttatttgaaaatactggatttaatagaaaatatcacattgtaaacaaatccattgatccatgagcttaaaacagaatgacggcacaatcacatagaaaagctaaagacaaaatactggtaccaaacatagcccttaggcctgggctaggctctcaaaggtctttcccagaaatggaggcagcagtagcttcaaacaggcacaaaaacagccaggaggaggcagcatccactccatgaaggcctaagacaatgaaaggaagccagagcaacagaccaccttgggatccggggagaagggtaaatgggcaaaagggttgtatttcctgatgctctcagaacatcagaccacaccatgtgaatttaagcaggactattttaagtggggaaacaatactagaagcatttggtgtattttcctggcactcacctcctaggtaagcaggagagcgggacactcaggagttgtgactaaactcacacttaagctgcctgtccagaccgtccccttggctgaacacaacactgaaattgtggcagtgtctgttgccccagtggacctcccacttactaatgagtatgtaaaacagaggagccacagtgaggcctttcacaaaaacacagggctctgggggaaaaacggcttccaccttctgccttttggtgctggagagtccctgagggagagaagtttgacgtggctgggccccttgaggctctggatttatcaatagaagcctcctctttggccccacccacccaaatccacccccaggttctcctagttcagagaaaagctgtgaaagtggaagaaggaagggatcgttttctttccattgcacttgttactgaccaaagagactgcttccttgcacttattttagatattgagagtttgtgccttcacttggaacaatggttctcaaccaaggggcaggcctgtgcaagaaggactctcaagaggtggtatccaatatacataagcccccctcggccgattcaccccggcctcgtactagtcgcg

SEQ ID NO: 291006 - DNA, 1906 bp, Homo sapiens
  misc_feature (522)..(522): n is a, c, g, or t
cattgagtataccatccagcaaaggcaccacctattatccgctacttggggctccatccacccaggaggtccccaagccagggagtttccacaacgttgaacggcgcctctctttttaatcgctcccttggccccttgacaaaaaccggtacggtaacttggccctcacggaactttaaaccgccccctttttttttttgttatttgaaaatactggatttaatagaaaatatcacattgtaaacaaatccattgatccatgagcttaaaacagaatgacggcacaatcacatagaaaagctaaagacaaaatactggtaccaaacatagcccttaggcctgggctaggctctcaaaggtctttcccagaaatggaggcagcagtagcttcaaacaggcacaaaaacagccaggaggaggcagcatccactccatgaaggcctaagacaatgaaaggaagccagagcaacagaccaccaaatgcttctagtattgtttccccacttaaaatagtcctgcttnaattcacatagggttgtatttcctgatgctctcagaacatcagaccacaccatgtgaatttaagcaggactattttaagtggggaaacaatactagaagcatttggtgtattttcctggcactcacctcctaggtaagcaggagagcgggacactcaggagttgtgactaaactcacacttaagctgcctgtccagaccgtccccttggctgaacacaacactgaaattgtggcagtgtctgttgccccagtggacctcccacttactaatgagtatgtaaaacagaggagccacagtgaggcctttcacaaaaacacagggctctgggggaaaaacggcttccaccttctgccttttggtgctggagagtccctgagggagagaagtttgacgtggctgggccccttgaggctctggatttatcaatagaagcctcctctttggccccacccacccaaatccacccccaggttctcctagttcagagaaaagctgtgaaagtggaagaaggaagggatcgttttctttccattgcacttgttactgaccaaagagactgcttccttgcacttattttagatattgagagtttgtgccttcacttggaacaatggttctcaaccaaggggcaggcctgtgcaagaaggactctcaagaggtggtatccaatatacataagcccctaattccctcccacttgaaaatcagtgcgtgtaaggagagaaattcctgacgggagtgtgtcatatgtgtgaaccatggctgaagcagaacaaaaagtttaaaactcccaacctgggtttggcagacatcaaaatgatggagtacattttgcagatattttttttctgattaagttacaaacattctccctatagctaaactccgtgactaggctcccagcctcatggccaagaacaataagttcacccacttatctggagtaaccatactagattaaagaaatacaattctttcttctaaagacaatttccagaaagacctgcctttccctatgggtacttgacactaggtcccagcacaggctaatcgctgtatggtttcttcgaagattggcttttctcagtttctttctctttgatactgtacaaggggtccaccaacttgttatgaacaagcattaaacctacaaaaaattaaaaacaaaaagtagttaattcaggcagtggcaagagttccttgattatcaatcataacatccaggagctctcaaattttgtcttagagctgacacttctctcttttctctatgatccccaaatgataaacaccctaagagtacaaaaagagttattcacagtgagtactacattcatggaacttttataaattcaatcactatgggagttggctatttaaagg

SEQ ID NO: 291007 - DNA, 1815 bp, Homo sapiens
cattgagtataccatccagcaaaggcaccacctattatccgctacttggggctccatccacccaggaggtccccaagccagggagtttccacaacgttgaacggcgcctctctttttaatcgctcccttggccccttgacaaaaaccggtacggtaacttggccctcacggaactttaaaccgccccctttttttttttgttatttgaaaatactggatttaatagaaaatatcacattgtaaacaaatccattgatccatgagcttaaaacagaatgacggcacaatcacatagaaaagctaaagacaaaatactggtaccaaacatagcccttaggcctgggctaggctctcaaaggtctttcccagaaatggaggcagcagtagcttcaaacaggcacaaaaacagccaggaggaggcagcatccactccatgaaggcctaagacaatgaaaggaagccagagcaacagaccaccttgggatccggggagaagggtaaatgggcaaatggggaaacaatactagaagcatttggtgtattttcctggcactcacctcctaggtaagcaggagagcgggacactcaggagttgtgactaaactcacacttaagctgcctgtccagaccgtccccttggctgaacacaacactgaaattgtggcagtgtctgttgccccagtggacctcccacttactaatgagtatgtaaaacagaggagccacagtgaggcctttcacaaaaacacagggctctgggggaaaaacggcttccaccttctgccttttggtgctggagagtccctgagggagagaagtttgacgtggctgggccccttgaggctctggatttatcaatagaagcctcctctttggccccacccacccaaatccacccccaggttctcctagttcagagaaaagctgtgaaagtggaagaaggaagggatcgttttctttccattgcacttgttactgaccaaagagactgcttccttgcacttattttagatattgagagtttgtgccttcacttggaacaatggttctcaaccaaggggcaggcctgtgcaagaaggactctcaagaggtggtatccaatatacataagcccctaattccctcccacttgaaaatcagtgcgtgtaaggagagaaattcctgacgggagtgtgtcatatgtgtgaaccatggctgaagcagaacaaaaagtttaaaactcccaacctgggtttggcagacatcaaaatgatggagtacattttgcagatattttttttctgattaagttacaaacattctccctatagctaaactccgtgactaggctcccagcctcatggccaagaacaataagttcacccacttatctggagtaaccatactagattaaagaaatacaattctttcttctaaagacaatttccagaaagacctgcctttccctatgggtacttgacactaggtcccagcacaggctaatcgctgtatggtttcttcgaagattggcttttctcagtttctttctctttgatactgtacaaggggtccaccaacttgttatgaacaagcattaaacctacaaaaaattaaaaacaaaaagtagttaattcaggcagtggcaagagttccttgattatcaatcataacatccaggagctctcaaattttgtcttagagctgacacttctctcttttctctatgatccccaaatgataaacaccctaagagtacaaaaagagttattcacagtgagtactacattcatggaacttttataaattcaatcactatgggagttggctatttaaagg

SEQ ID NO: 291008 - DNA, 1466 bp, Homo sapiens
agtcgactctacagtatcccccgcaaactggattcactgtctggctaacgaatttattgttaatcacacatactttactgcaaaactgcaaaatctttacccataagctgcccaggcagctagctatcttttatttcgctgctatcaccaaaatcaattattctgtactcccagtgcaatcccacgtgtgggatttcctggcactcacctcctaggtaagcaggagagcgggacactcaggagttgtgactaaactcacacttaagctgcctgtccagaccgtccccttggctgaacacaacactgaaattgtggcagtgtctgttgccccagtggacctcccacttactaatgagtatgtaaaacagaggagccacagtgaggcctttcacaaaaacacagggctctgggggaaaaacggcttccaccttctgccttttggtgctggagagtccctgagggagagaagtttgacgtggctgggccccttgaggctctggatttatcaatagaagcctcctctttggccccacccacccaaatccacccccaggttctcctagttcagagaaaagctgtgaaagtggaagaaggaagggatcgttttctttccattgcacttgttactgaccaaagagactgcttccttgcacttattttagatattgagagtttgtgccttcacttggaacaatggttctcaaccaaggggcaggcctgtgcaagaaggactctcaagaggtggtatccaatatacataagcccctaattccctcccacttgaaaatcagtgcgtgtaaggagagaaattcctgacgggagtgtgtcatatgtgtgaaccatggctgaagcagaacaaaaagtttaaaactcccaacctgggtttggcagacatcaaaatgatggagtacattttgcagatattttttttctgattaagttacaaacattctccctatagctaaactccgtgactaggctcccagcctcatggccaagaacaataagttcacccacttatctggagtaaccatactagattaaagaaatacaattctttcttctaaagacaatttccagaaagacctgcctttccctatgggtacttgacactaggtcccagcacaggctaatcgctgtatggtttcttcgaagattggcttttctcagtttctttctctttgatactgtacaaggggtccaccaacttgttatgaacaagcattaaacctacaaaaaattaaaaacaaaaagtagttaattcaggcagtggcaagagttccttgattatcaatcataacatccaggagctctcaaattttgtcttagagctgacacttctctcttttctctatgatccccaaatgataaacaccctaagagtacaaaaagagttattcacagtgagtactacattcatggaacttttataaattcaatcactatgggagttggctatttaaagg

SEQ ID NO: 291009 - DNA, 594 bp, Homo sapiens
cattgagtataccatccagcaaaggcaccacctattatccgctacttggggctccatccacccaggaggtccccaagccagggagtttccacaacgttgaacggcgcctctctttttaatcgctcccttggccccttgacaaaaaccggtacggtaacttggccctcacggaactttaaaccgccccctttttttttttgttatttgaaaatactggatttaatagaaaatatcacattgtaaacaaatccattgatccatgagcttaaaacagaatgacggcacaatcacatagaaaagctaaagacaaaatactggtaccaaacatagcccttaggcctgggctaggctctcaaaggtctttcccagaaatggaggcagcagtagcttcaaacaggcacaaaaacagccaggaggaggcagcatccactccatgaaggcctaagacaatgaaaggaagccagagcaacagaccaccttgggatccggggagaagggtaaatgggcaaagtaaatgcttctagtattgtttccccacttaaaatagtcctgcttaaattcacatggtgtggtctgatgttctgagagcatcag

SEQ ID NO: 291010 - DNA, 1213 bp, Homo sapiens
cattgagtataccatccagcaaaggcaccacctattatccgctacttggggctccatccacccaggaggtccccaagccagggagtttccacaacgttgaacggcgcctctctttttaatcgctcccttggccccttgacaaaaaccggtacggtaacttggccctcacggaactttaaaccgccccctttttttttttgttatttgaaaatactggatttaatagaaaatatcacattgtaaacaaatccattgatccatgagcttaaaacagaatgacggcacaatcacatagaaaagctaaagacaaaatactggtaccaaacatagcccttaggcctgggctaggctctcaaaggtctttcccagaaatggaggcagcagtagcttcaaacaggcacaaaaacagccaggaggaggcagcatccactccatgaagaatggttctcaaccaaggggcaggcctgtgcaagaaggactctcaagaggtggtatccaatatacataagcccctaattccctcccacttgaaaatcagtgcgtgtaaggagagaaattcctgacgggagtgtgtcatatgtgtgaaccatggctgaagcagaacaaaaagtttaaaactcccaacctgggtttggcagacatcaaaatgatggagtacattttgcagatattttttttctgattaagttacaaacattctccctatagctaaactccgtgactaggctcccagcctcatggccaagaacaataagttcacccacttatctggagtaaccatactagattaaagaaatacaattctttcttctaaagacaatttccagaaagacctgcctttccctatgggtacttgacactaggtcccagcacaggctaatcgctgtatggtttcttcgaagattggcttttctcagtttctttctctttgatactgtacaaggggtccaccaacttgttatgaacaagcattaaacctacaaaaaattaaaaacaaaaagtagttaattcaggcagtggcaagagttccttgattatcaatcataacatccaggagctctcaaattttgtcttagagctgacacttctctcttttctctatgatccccaaatgataaacaccctaagagtacaaaaagagttattcacagtgagtactacattcatggaacttttataaattcaatcactatgggagttggctatttaaagg

SEQ ID NO: 291011 - DNA, 1155 bp, Homo sapiens
cattgagtataccatccagcaaaggcaccacctattatccgctacttggggctccatccacccaggaggtccccaagccagggagtttccacaacgttgaacggcgcctctctttttaatcgctcccttggccccttgacaaaaaccggtacggtaacttggccctcacggaactttaaaccgccccctttttttttttgttatttgaaaatactggatttaatagaaaatatcacattgtaaacaaatccattgatccatgagcttaaaacagaatgacggcacaatcacatagaaaagctaaagacaaaatactggtaccaaacatagcccttaggcctgggctaggctctcaaaggtctttcccagaaatggaggcagcagtagcttcaaacaggcacaaaaacagccaggaggaggcagcatccactccatgaagaatggttctcaaccaaggggcaggcctgtgcaagaaggactctcaagaggtggtatccaatatacataagcccctaattccctcccacttgaaaatcagtgcgtgtaaggagagaaattcctgacgggagtgtgtcatatgtgtgaaccatggctgaagcagaacaaaaaatattttttttctgattaagttacaaacattctccctatagctaaactccgtgactaggctcccagcctcatggccaagaacaataagttcacccacttatctggagtaaccatactagattaaagaaatacaattctttcttctaaagacaatttccagaaagacctgcctttccctatgggtacttgacactaggtcccagcacaggctaatcgctgtatggtttcttcgaagattggcttttctcagtttctttctctttgatactgtacaaggggtccaccaacttgttatgaacaagcattaaacctacaaaaaattaaaaacaaaaagtagttaattcaggcagtggcaagagttccttgattatcaatcataacatccaggagctctcaaattttgtcttagagctgacacttctctcttttctctatgatccccaaatgataaacaccctaagagtacaaaaagagttattcacagtgagtactacattcatggaacttttataaattcaatcactatgggagttggctatttaaagg

SEQ ID NO: 291012 - DNA, 2318 bp, Homo sapiens
tggcagcgacgcggtgaggagacggcccacggcgcccgcgggctggggcggtcgcttcttccttctccgtggcctacgaggagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291013 - DNA, 945 bp, Homo sapiens
gctgctccggtccggaaggtctaggctgtggcagcgacgcggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggttgttcggcctgtgcccgatgtcaggactgacgatcaactgttgcatgcagagggtggctgatcacctcagtgtgtgacgggccagctgctaggcgatgggggcaggccgtcgcggaaaatgagcctggatacaggggccatgtcacggatctggaacacgggcggcaccacctgcacccggggcccgctgccgggcaccagcctgggcccaacctccacacggggcacctagagccgcgaggccccc

SEQ ID NO: 291014 - DNA, 336 bp, Homo sapiens
taatcattccagtacccagattattcctgtaacttactgcacaatcatcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291015 - DNA, 785 bp, Homo sapiens
  misc_feature (102)..(102): n is a, c, g, or t
ggctcctcttaggccccccgggtttccctttaagctcccgctcgtatgtgtgggaaattggaggcggatacaatttccccaggaacaggtatgccatgattncgcaggctcgaattacccctcactaaggggaccaagttggagctccccccggtgcgggcgcttctagacctagtgatcccccgggctcagggaatcggctcagctggaaaaggggctagactgagtcatatgcagtatagttatcatcatgtactaaagaaatgatagacttcccagccccttcatttcccatgccagatcggactatggtaccttcctggggaggggcgggtgctgacctggagcctccatgatcgccatccatcctcacacacagtcctggcacaagagctgaacttactaccagcctcttttagagcagtctttcctgaagctacagataaagagctagctacaaagatggcaaattcagtctttgtaaaagaaaatattggctgggcgcggtggctcacacctgtaatcccaacactttgggaggctgcggtgggtggatcatgaggtcaggagatcgagaccatcgtggctatcatggtgaaacaccgtctctactaaaaaatacaaaaaattagccgggcatggtggcgggcgcctctagtcccagctactctggaggctgaggcagaagaatggcatgaacccggcaggcggagcttgcagtgagccgagatcatgccactgcactccagcctgggcgacagagcgagactctgtctcaaaaaaaa

SEQ ID NO: 291016 - DNA, 2090 bp, Homo sapiens
tggcagcgacgcggtgaggagacggcccacggcgcccgcgggctggggcggtcgcttcttccttctccgtggcctacgaggcctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291017 - DNA, 2524 bp, Homo sapiens
tggcagcgacgcggtgaggagacggcccacggcgcccgcgggctggggcggtcgcttcttccttctccgtggcctacgaggagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcggtgagtctcctgctgatgggacacaggcacctgggagtgcctcacccagcatgaatggtgaagaggctggaatatgggcaggtgggggaaggaagggtggaatgttgcctgggcaagggcagaggggagtgttgagatggacaagatggagtcagggtgctgggtggggggccctagcaggactctgacccctccctcccctcaagatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291018 - DNA, 2781 bp, Homo sapiens
tggcagcgacgcggtgaggagacggcccacggcgcccgcgggctggggcggtcgcttcttccttctccgtggcctacgaggagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccaggtgcattccccatcttaactgatttaacccctgaaacaacccgacgctggaagttgggttctcatccccactctacatatgtaaaaatgaagatgcagagagatgaagctactttcccagggctatatggcaagcaagtcgcaaagctgggatcccaatccagacagtctgaccgtggaacgagactcatacacgtaataaatgctctgcccccaacttgtccaccacatggccttggcaagtccaacccctttacctctctgagcctcactttcccatttagtgagacagggatggtaactgccccttgcagggtggttttgagcagtaaatgtagtgtgcctggcttgctgggcaggcctggtggccatgatgatcaggtgtgtgggagttctggggagactccaagaactaccaggaacagggatacgagtgccaggctgcatctcttgctcctctgcagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291019 - DNA, 1175 bp, Homo sapiens
agttcatggtttcctccagaggagacattggctttctgcgtgaacactgagggctcctatgagtgccgagactgtgccaaggcctgcctaggctgcatgggggcagggccaggtcgctgtaagaagtgtagccctggctatcagcaggtgggctccaagtgtctcggtgagtctcctgctgatgggacacaggcacctgggagtgcctcacccagcatgaatggtgaagaggctggaatatgggcaggtgggggaaggaagggtggaatgttgcctgggcaagggcagaggggagtgttgagatggacaagatggagtcagggtgctgggtggggggccctagcaggactctgacccctccctcccctcaagatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291020 - DNA, 1489 bp, Homo sapiens
cctcattcaaagagaaggcaggcaagccccttccccaggtagcagtggcagctccaggccctgccccatccctactgccacccagccccctggaggctgcactgagaccgggctctacatctgatctccaggttggctctcagcagccttataccttccagggtacaaagggaatcagacctggcatcaaatcagtctgcctccttaacctgtttcctcatctatccaatgggaccagtgtttgccctggcctgctgagagctgtcctaggccgggggtgtggtgagatgcagggtaatcacaacgatgatggcagggaccatttccccagcaattactgtgtcagatgctgttctaggtgcattccccatcttaactgatttaacccctgaaacaacccgacgctggaagttgggttctcatccccactctacatatgtaaaaatgaagatgcagagagatgaagctactttcccagggctatatggcaagcaagtcgcaaagctgggatcccaatccagacagtctgaccgtggaacgagactcatacacgtaataaatgctctgcccccaacttgtccaccacatggccttggcaagtccaacccctttacctctctgagcctcactttcccatttagtgagacagggatggtaactgccccttgcagggtggttttgagcagtaaatgtagtgtgcctggcttgctgggcaggcctggtggccatgatgatcaggtgtgtgggagttctggggagactccaagaactaccaggaacagggatacgagtgccaggctgcatctcttgctcctctgcagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291021 - DNA, 1431 bp, Homo sapiens
  misc_feature (102)..(102): n is a, c, g, or t
ggctcctcttaggccccccgggtttccctttaagctcccgctcgtatgtgtgggaaattggaggcggatacaatttccccaggaacaggtatgccatgattncgcaggctcgaattacccctcactaaggggaccaagttggagctccccccggtgcgggcgcttctagacctagtgatcccccgggctcagggaatcggctcagctggaaagccgggggtgtggtgagatgcagggtaatcacaacgatgatggcagggaccatttccccagcaattactgtgtcagatgctgttctaggtgcattccccatcttaactgatttaacccctgaaacaacccgacgctggaagttgggttctcatccccactctacatatgtaaaaatgaagatgcagagagatgaagctactttcccagggctatatggcaagcaagtcgcaaagctgggatcccaatccagacagtctgaccgtggaacgagactcatacacgtaataaatgctctgcccccaacttgtccaccacatggccttggcaagtccaacccctttacctctctgagcctcactttcccatttagtgagacagggatggtaactgccccttgcagggtggttttgagcagtaaatgtagtgtgcctggcttgctgggcaggcctggtggccatgatgatcaggtgtgtgggagttctggggagactccaagaactaccaggaacagggatacgagtgccaggctgcatctcttgctcctctgcagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291022 - DNA, 667 bp, Homo sapiens
tgtggtgttctagaggatcccaacgaccgaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291023 - DNA, 2075 bp, Homo sapiens
tggcagcgacgcggtgaggagacggcccacggcgcccgcgggctggggcggtcgcttcttccttctccgtggcctacgaggagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttccaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291024 - DNA, 2022 bp, Homo sapiens
tggcagcgacgcggtgaggagacggcccacggcgcccgcgggctggggcggtcgcttcttccttctccgtggcctacgaggagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291025 - DNA, 1949 bp, Homo sapiens
tggcagcgacgcggtgaggagacggcccacggcgcccgcgggctggggcggtcgcttcttccttctccgtggcctacgaggagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggcggagaggcagtcagagcagagtggctggggcaggaatcacagcaaggctgggtatgaactgagaggcactctcgaaggttcttccacggtgtgaatgaccgacactgaataggcaaggtgtgacctgccacccgacctgcaagagcgcaca

SEQ ID NO: 291026 - DNA, 493 bp, Homo sapiens
atattacagtcccaaagtgagtagtccaggctggcaggggagctctgctagtcataatcattccagtacccagattattcctgtaacttactgcacaatcatccccttgggcgttgtctgcatggttgaagctgagtcctgggcatctctgtgtcccacatgccagcactcaggaagggagaagggaaagaaagtgcattgaggagtccaagcattgttttaagaccaagctaacggtggagctcatcactcctgtttacatcctgttggccagaactcaatcacagggacacacttagcttcaagacaggttggcaaatgtggtctctggctgggcagcctgaagtccagctagtctgcttctgtgttggtagacagcttgcagtctctgccataccatttaatcccaggcaagaccattccccaacggctctggcttcagcttccctactaaatagggattgaaattctcaccctgctcacctctctgcag

SEQ ID NO: 291027 - DNA, 2010 bp, Homo sapiens
tggcagcgacgcggtgaggagacggcccacggcgcccgcgggctggggcggtcgcttcttccttctccgtggcctacgagggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccaggtgcattccccatcttaactgatttaacccctgaaacaacccgacgctggaagttgggttctcatccccactctacatatgtaaaaatgaagatgcagagagatgaagctactttcccagggctatatggcaagcaagtcgcaaagctgggatcccaatccagacagtctgaccgtggaacgagactcatacacagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291028 - DNA, 1359 bp, Homo sapiens
tggcagcgacgcggtgaggagacggcccacggcgcccgcgggctggggcggtcgcttcttccttctccgtggcctacgagggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagtgagtggcaaagggccttccctggaagtgggtcacaggcagcaggaggccccggacctcttccagtggctgtgctcagattccctgaagctctgctgccccgcaggcaccttcgggccctcctgccttcgtgagtttttaagttgctcttggggatgggaggggaccaccgagtccagggatccagtcctggctctgtccctagttcgctgtgtgaactcaggctactcagataaacttctctggacctcagttcttgcctgcctgacagggctggggagatgggcaaatcagtggggaaaggcttggagaaagcacaggggctagactgagtcatatgcagtatagttatcatcatgtactaaagaaatgatagacttcccagccccttcatttcccatgccagatcggactatggtaccttcctggggaggggcgggtgctgacctggagcctccatgatcgccatccatcctcacacacagtcctggcacaagagctgaacttactaccagcctcttttagagcagtctttcctgaagctacagataaagagctagctacaaagatggcaaattcagtctttgtaaaagaaaatattggctgggcgcggtggctcacacctgtaatcccaacactttgggaggctgcggtgggtggatcatgaggtcaggagatcgagaccatcgtggctatcatggtgaaacaccgtctctactaaaaaatacaaaaaattagccgggcatggtggcgggcgcctctagtcccagctactctggaggctgaggcagaagaatggcatgaacccggcaggcggagcttgcagtgagccgagatcatgccactgcactccagcctgggcgacagagcgagactctgtctcaaaaaaaa

SEQ ID NO: 291029 - DNA, 1776 bp, Homo sapiens
gctgctccggtccggaaggtctaggctgtggcagcgacgcggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291030 - DNA, 1843 bp, Homo sapiens
aggtgagagagacagggcacaggggcgctgggggcgtggggcggggctcgttctctcttctttcggtgggctaagaatggttcccaagctgggtaaagaattgcccatgggccccgaaggggctaattccaagttggtgtcctgggggctcaagctcctttcttaaacttccaatgaactaattttgggttcaaggccttccttcaaccttcccaaggttctttccttcccctggctcaaggccccatcccggtggttcataacctgggcggggaactggtttgacaaggtttaaacaaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291031 - DNA, 2492 bp, Homo sapiens
tggcagcgacgcggtgaggagacggcccacggcgcccgcgggctggggcggtcgcttcttccttctccgtggcctacgaggagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcggtgagtctcctgctgatgggacacaggcacctgggagtgcctcacccagcatgaatggtgaagaggctggaatatgggcagatggaaggcatctgtgtgaaggagcagatcccaggtgcattccccatcttaactgatttaacccctgaaacaacccgacgctggaagttgggttctcatccccactctacatatgtaaaaatgaagatgcagagagatgaagctactttcccagggctatatggcaagcaagtcgcaaagctgggatcccaatccagacagtctgaccgtggaacgagactcatacacagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291032 - DNA, 2691 bp, Homo sapiens
tggcagcgacgcggtgaggagacggcccacggcgcccgcgggctggggcggtcgcttcttccttctccgtggcctacgaggagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaaggcatcagtcttactacctgtcccaccacccccaccttagggaaatgtcctagaatcctgggaaattgagggcttctttgatggtgagtggagaaaagatagaggagaaggttgcccctgaagtgctgttaggagaaggaggatagaggaatcagccttaggagggttccatgccagctgtcatttggcaaaggaccctggacagatgacttttgcctctgaacttcactcttctctttcctcaaatgggcttcataatgctttccactcaggcttaacatgagaattaaatgaggtgacaaatgtgaagacctggacagtacacaacagatattcaataaaagtgtggtcgccattatgaccagagcctcca

SEQ ID NO: 291033 - DNA, 2957 bp, Homo sapiens
tggcagcgacgcggtgaggagacggcccacggcgcccgcgggctggggcggtcgcttcttccttctccgtggcctacgaggagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaaaaaaaaaaaaaaaaaacacgaacgaacgcaccaacaagacaaccatagaaacaacacagcacacaaagagaaaaactcgacaccacacacaaagcagtgtcgggtcgcccacgccggtccaccaagaagagagtttctaaaacccacgaagtggggggcgggggccccccaggggtgtgtactgacaaccacctgggcgagaatgccacaaaagaaacaagaggcggaacccaaacaagtagtgtgtcatcccacacaatagaagacgcgcccgggaacgagcggtgtactaaccaacaacacagaacggggcacaggacgagggcacagagtggaggctaccaaaaaggagggcacgacgggcgaggaagaacaatccgccccggcggggggggcaaaagacagcaagaaaagagaagcacagcaacagagaacagaagaaagcaagaacaagacgaacaagaaagaaacacacaccaaagccaagcgcaggacaagcgaagcagagcagaagaagaaaacaggcaaactaaaataaccaacgcaggaacacgcacaacaaataagcgaacagacaacaagaaaagaacagatgatacaggacgacgaacaaaacaagacaggatacgaactcagtcc

SEQ ID NO: 291034 - DNA, 2448 bp, Homo sapiens
tggcagcgacgcggtgaggagacggcccacggcgcccgcgggctggggcggtcgcttcttccttctccgtggcctacgaggagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttccaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaaggcatcagtcttactacctgtcccaccacccccaccttagggaaatgtcctagaatcctgggaaattgagggcttctttgatggtgagtggagaaaagatagaggagaaggttgcccctgaagtgctgttaggagaaggaggatagaggaatcagccttaggagggttccatgccagctgtcatttggcaaaggaccctggacagatgacttttgcctctgaacttcactcttctctttcctcaaatgggcttcataatgctttccactcaggcttaacatgagaattaaatgaggtgacaaatgtgaagacctggacagtacacaacagatattcaataaaagtgtggtcgccattatgaccagagcctcca

SEQ ID NO: 291035 - DNA, 2023 bp, Homo sapiens
tggcagcgacgcggtgaggagacggcccacggcgcccgcgggctggggcggtcgcttcttccttctccgtggcctacgaggagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 291036 - DNA, 1823 bp, Homo sapiens
tggcagcgacgcggtgaggagacggcccacggcgcccgcgggctggggcggtcgcttcttccttctccgtggcctacgaggagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttcgtgagtttttaagttgctcttggggatgggaggggaccaccgagtccagggatccagtcctggctctgtccctagttcgctgtgtgaactcaggctactcagataaacttctctggacctcagttcttgcctgcctgacagggctggggagatgggcaaatcagtggggaaaggcttggagaaagcacaggggctagactgagtcatatgcagtatagttatcatcatgtactaaagaaatgatagacttcccagccccttcatttcccatgccagatcggactatggtaccttcctggggaggggcgggtgctgacctggagcctccatgatcgccatccatcctcacacacagtcctggcacaagagctgaacttactaccagcctcttttagagcagtctttcctgaagctacagataaagagctagctacaaagatggcaaattcagtctttgtaaaagaaaatattggctgggcgcggtggctcacacctgtaatcccaacactttgggaggctgcggtgggtggatcatgaggtcaggagatcgagaccatcgtggctatcatggtgaaacaccgtctctactaaaaaatacaaaaaattagccgggcatggtggcgggcgcctctagtcccagctactctggaggctgaggcagaagaatggcatgaacccggcaggcggagcttgcagtgagccgagatcatgccactgcactccagcctgggcgacagagcgagactctgtctcaaaaaaaa

SEQ ID NO: 291037 - DNA, 2626 bp, Homo sapiens
tgtgaaattgagaatcatgataaaatcctcatacctcctcctcttttgaccaaatctttctaaaatgcacaattataatttcttatctttaggaaaaagtaattatgttatatgtgttatatacactatgtaaatatagttcattaaatcattctttggtgtttgaagactttctaattcattacttcattccagacatcaatgacaacagcacataccgagcaggtacacatatgagctacctactaatatgccctgattttgattgtattttgtgaaaaccttggtatgggttatttttaaatgaatgttttcccaaattttaagctgaaactaggatgcatcaaaattatcttggtcataatcttgtcaatgatgtcatctaaaggccaccaggaacacacctgtagcccagcaaagttgaggccatcgactggctcatcacaacaaggaaggctgtgcaccactgggacccagcagcagctcagcagcagcagtgagagggccttgggaaagacttggagggtttggcttatacaaggtgatcttggggagggtcaaggaaacaggctgtgatggttaatattgagtgtcaacttgattggattgaaggatgcaaaggattgttcctgggtgtatatgtgagagtgtggccaaaggagattaacattttagtcagtggactgggagaggcacacccaccctcaatctgggtgggcatcatctaatcagctgccacagcagctaaaataaagcaggcagaagttggaatgagcagacttgctgagtgttccagccttcatctttctcccatgctggatgcttcctgccctcgaacatcagactccaagttcttcagcttttttttttttttttggactcttggacttacagcattggtttgccaggggctcccaggcctctagccgcagactgaaggctgcactgtgagcctccctacctttgaagtttgggactcagactggcttcttggctcctcagcttgcagtcggcctattgtgagacttccccttgtgatcatgtgagccaattctcctgataaactcaccttcatatatacatctatcctattagttctatccgtttagagaaccctgactaatacacaggccatgctcagatggagtgctgtctggaaatgggagtaattctgtggttgaatgtcttaattgtcctggaaggtgggagaaatggaatgaggctggtgctacaattgatgtaaaagcagcagctgctcacataagccggggtggaggatgcctaggcgtatttgtggtattgaccatgttcttgtttttgtttgtgaccagaccagattacagaggggtattgatttgccttgcccccgcccccaccatcacagtgtgtccctgtccagtgttggtgctgtgtggcattgcttgtgtccataggagtccatcaaggcagagcggcagagcggcaagcagagcggcaaggcaggtcagcttccggctcttccaggctgcatgtccccctcaatatcctttcaacccaatggaaatggattgaaagagtgaaagtcactggtctcaaagaatctacggaatttagcattttgaaaatcacagagcaattttgggtaggtattcacatgcactaaaaaaccaggcaaacatctgactcccaggataaagtgactgagagcagtagaagacttgttgagccttaaggaataagaggaaaattatgttatgaagtgcaggaacagcacagacccagacgaggggatgcagcccggagccagtaacccggcgcctcctcctccccagggcgcagcgctggctgctccccggataccgtgatcacacgtcccaggtcctgagagcgcctcataggtagacagttctttgggacttttgggacgcagcacttgaagagaggtttacctaaactttcctcctgggagcctgtcatcatttgaaagtaacagaagaaagctgtcaggctgaggaaagtttcaacaggcacttggtgagaatgggaagcatccattcattgggaaatcacggggacagaggaggaattcacgggatcagagcactgagaaactccagaggcttctggttcaccgccctgattccacagatgtgggtcagaggcagagatggaagttggaatggacaagcctgccctctcctcagctctccatggctctgtcctcaggctgtttctgcaatttgacatgaggcctggccccagggaaaccagtggggcctcatctcctccctgtgctgctctgaggtggagccttctcagggtcagtccagctctggagcccctctccagctcggtcaccaaagctgtctggtcccagggcagtgtggagtgacaggcacgccagccaatccaatcggccatttcatacccaatgcatgtgactgataaagagataacaccctgtctccaagacacaggctttacataaacagctttaatgacttcttcacttagggacaagactccttagtggtggaacctcaggcatccatgcaggatgtaagaaagctcccgtatatacatgaactgagaagtgtgtagaagagtaaatactgtaataggtaataaaatgtatgtatttttattt

SEQ ID NO: 291038 - DNA, 1637 bp, Homo sapiens
ctgcagttgtttgggctgtcgctgtggctggttctgcggtgtgcggccagccatggagcgctctgggcccagcgaagtgacaggctcagacgcatcgggaccggacccgcagcttgtggtcaccatgggcttcacggggttcggggttcggtaaaaaagctcacacatttgacttggaagcaatgtttgaacaaactcaaagaacagctgtggaaagaagtcacaaaacactgggccaccaggaacacacctgtagcccagcaaagttgaggccatcgactggctcatcacaacaaggaaggctgtgcaccactgggacccagcagcagctcagcagcagcagtgagagggccttgggaaagacttggagggtttggcttatacaagaccagattacagaggggtattgatttgccttgcccccgcccccaccatcacagtgtgtccctgtccagtgttggtgctgtgtggcattgcttgtgtccataggagtccatcaaggcagagcggcagagcggcaagcagagcggcaaggcagttcaacccaatggaaatggattgaaagagtgaaagtcactggtctcaaagaatctacggaatttagcattttgaaaatcacagagcaattttgggtaggtattcacatgcactaaaaaaccaggcaaacatctgactcccaggataaagtgactgagagcagtagaagacttgttgagccttaaggaataagaggaaaattatgttatgaagtgcaggaacagcacagacccagacgaggggatgcagcccggagccagtaacccggcgcctcctcctccccagggcgcagcgctggctgctccccggataccgtgatcacacgtcccaggtcctgagagcgcctcataggtagacagttctttgggacttttgggacgcagcacttgaagagaggtttacctaaactttcctcctgggagcctgtcatcatttgaaagtaacagaagaaagctgtcaggctgaggaaagtttcaacaggcacttggtgagaatgggaagcatccattcattgggaaatcacggggacagaggaggaattcacgggatcagagcactgagaaactccagaggcttctggttcaccgccctgattccacagatgtgggtcagaggcagagatggaagttggaatggacaagcctgccctctcctcagctctccatggctctgtcctcaggctgtttctgcaatttgacatgaggcctggccccagggaaaccagtggggcctcatctcctccctgtgctgctctgaggtggagccttctcagggtcagtccagctctggagcccctctccagctcggtcaccaaagctgtctggtcccagggcagtgtggagtgacaggcacgccagccaatccaatcggccatttcatacccaatgcatgtgactgataaagagataacaccctgtctccaagacacaggctttacataaacagctttaatgacttcttcacttagggacaagactccttagtggtggaacctcaggcatccatgcaggatgtaagaaagctcccgtatatacatgaactgagaagtgtgtagaagagtaaatactgtaataggtaataaaatgtatgtatttttattt

SEQ ID NO: 291039 - DNA, 341 bp, Homo sapiens
tccaagacgggaggtgaagaccagcctcatagcgagactgcatctctacaaaatattttaaaactaggctgcacatggtggtgcacgcctgtagtcccagctactactcttggtatcgcaactacgggcacctggagttgattcagctgcagctggccacccagtttgagaattggtgtaagacatcacaatcccattattcagagcgcgtatggagtggaaacgcttgtagggtttcaccaggtaagcggtgttgaactttctgcttgtgtattctctctgggcagagatgccacttgcctcccccaccctgccgtgcgcccactgcagtgctcccctcg

SEQ ID NO: 291040 - DNA, 1934 bp, Homo sapiens
ctgcagttgtttgggctgtcgctgtggctggttctgcggtgtgcggccagccatggagcgctctgggcccagcgaagtgacaggctcagacgcatcgggaccggacccgcagcttgtggtcaccatgggcttcacggggttcggggttcggtaaaaaagctcacacatttgacttggaagcaatgtttgaacaaactcaaagaacagctgtggaaagaagtcacaaaacactgggccaccaggaacacacctgtagcccagcaaagttgaggccatcgactggctcatcacaacaaggaaggctgtgcaccactgggacccagcagcagctcagcagcagcagtgagagggccttgggaaagacttggagggtttggcttatacaagaccagattacagaggggtattgatttgccttgcccccgcccccaccatcacagtgtgtccctgtccagtgttggtgctgtgtggcattgcttgtgtccataggagtccatcaaggcagagcggcagagcggcaagcagagcggcaaggcaggtcagcttccggctcttccaggctgcatgtccccctcaatatcctttcaacccaatggaaatggattgaaagagtgaaagtcactggtctcaaagaatctacggaatttagcattttgaaaatcacagagcaattttgggtaggtattcacatgcactaaaaaaccaggcaaacatctgactcccaggataaagtgactgagagcagtagaagacttgttgagccttaaggaataagaggaaaattatgttatgaagtgcaggaacagcacagacccagacgaggggatgcagcccggagccagtaacccggcgcctcctcctccccagggcgcagcgctggctgctccccggataccgtgatcacacgtcccaggtcctgagagcgcctcataggtagacagttctttgggacttttgggacgcagcacttgaagagaggtttacctaaactttcctcctgggagcctgtcatcatttgaaagtaacagaagaaagctgtcaggctgaggaaagtttcaacaggcacttggtgagaatgggaagcatccattcattgggaaatcacggggacagaggaggaattcacgggatcagagcactgagaaactccagaggcttctggttcaccgccctgattccacagatgtgggtcagaggcagagatggaagttggaatggacaagcctgccctctcctcagctctccatggctctgtcctcaggctgtttctgcaatttgacatgaggcctggccccagggaaaccagtggggcctcatctcctccctgtgctgctctgaggtggagccttctcagggtcagtccagctctggagcccctctccagctcggtcaccaaagctgtctggtcccagggcagtgtggagtgacaggcacgccagccaatccaatcggccatttcatacccaatgcatgtgactgataaagagataacaccctgtctccaagacacaggctttacataaacagctttaatgacttcttcacttagggacaagactccttagtggtggaacctcaggcatccatgcaggatgtaagaaagctcccgtatatacatgaactgagaagtgtgtagaagagtaaatactgtaataggtaataaaatgtatgtatttttatttatgtgctactttgtctttctccctctctgtgtatatacacatacatacaaaaatgtattcattctatggaaaacatgaaagatgtaatattctttacatatttaattaatgtattttttctgatcatatgaacaccacaaatataattttataatttttttacctaacaataagtcttaaacataaatatacatggacaatatcatagttttttttttaatcataattaaaatggttgtgaaacattccact

SEQ ID NO: 291041 - DNA, 2589 bp, Homo sapiens
tgtgaaattgagaatcatgataaaatcctcatacctcctcctcttttgaccaaatctttctaaaatgcacaattataatttcttatctttaggaaaaagtaattatgttatatgtgttatatacactatgtaaatatagttcattaaatcattctttggtgtttgaagactttctaattcattacttcattccagacatcaatgacaacagcacataccgagcaggtacacatatgagctacctactaatatgccctgattttgattgtattttgtgaaaaccttggtatgggttatttttaaatgaatgttttcccaaattttaagctgaaactaggatgcatcaaaattatcttggtcataatcttgtcaatgatgtcatctaaaggccaccaggaacacacctgtagcccagcaaagttgaggccatcgactggctcatcacaacaaggaaggctgtgcaccactgggacccagcagcagctcagcagcagcagtgagagggccttgggaaagacttggagggtttggcttatacaaggtgatcttggggagggtcaaggaaacaggctgtgatggttaatattgagtgtcaacttgattggattgaaggatgcaaaggattgttcctgggtgtatatgtgagagtgtggccaaaggagattaacattttagtcagtggactgggagaggcacacccaccctcaatctgggtgggcatcatctaatcagctgccacagcagctaaaataaagcaggcagaagttggaatgagcagacttgctgagtgttccagccttcatctttctcccatgctggatgcttcctgccctcgaacatcagactccaagttcttcagcttttttttttttttttggactcttggacttacagcattggtttgccaggggctcccaggcctctagccgcagactgaaggctgcactgtgagcctccctacctttgaagtttgggactcagactggcttcttggctcctcagcttgcagtcggcctattgtgagacttccccttgtgatcataccagattacagaggggtattgatttgccttgcccccgcccccaccatcacagtgtgtccctgtccagtgttggtgctgtgtggcattgcttgtgtccataggagtccatcaaggcagagcggcagagcggcaagcagagcggcaaggcaggtcagcttccggctcttccaggctgcatgtccccctcaatatcctttcaacccaatggaaatggattgaaagagtgaaagtcactggtctcaaagaatctacggaatttagcattttgaaaatcacagagcaattttgggtaggtattcacatgcactaaaaaaccaggcaaacatctgactcccaggataaagtgactgagagcagtagaagacttgttgagccttaaggaataagaggaaaattatgttatgaagtgcaggaacagcacagacccagacgaggggatgcagcccggagccagtaacccggcgcctcctcctccccagggcgcagcgctggctgctccccggataccgtgatcacacgtcccaggtcctgagagcgcctcataggtagacagttctttgggacttttgggacgcagcacttgaagagaggtttacctaaactttcctcctgggagcctgtcatcatttgaaagtaacagaagaaagctgtcaggctgaggaaagtttcaacaggcacttggtgagaatgggaagcatccattcattgggaaatcacggggacagaggaggaattcacgggatcagagcactgagaaactccagaggcttctggttcaccgccctgattccacagatgtgggtcagaggcagagatggaagttggaatggacaagcctgccctctcctcagctctccatggctctgtcctcaggctgtttctgcaatttgacatgaggcctggccccagggaaaccagtggggcctcatctcctccctgtgctgctctgaggtggagccttctcagggtcagtccagctctggagcccctctccagctcggtcaccaaagctgtctggtcccagggcagtgtggagtgacaggcacgccagccaatccaatcggccatttcatacccaatgcatgtgactgataaagagataacaccctgtctccaagacacaggctttacataaacagctttaatgacttcttcacttagggacaagactccttagtggtggaacctcaggcatccatgcaggatgtaagaaagctcccgtatatacatgaactgagaagtgtgtagaagagtaaatactgtaataggtaataaaatgtatgtatttttatttatgtgctactttgtctttctccctctctgtgtatatacacatacatacaaaaatgtattcattctatggaaaacatgaaagatgtaatattctttacatatttaattaatgtattttttctgatcatatgaacaccacaaatataattttataatttttttacctaacaataagtcttaaacataaatatacatggacaatatcatagttttttttttaatcataattaaaatggttgtgaaacattccact

SEQ ID NO: 291042 - DNA, 1781 bp, Homo sapiens
ctgcagttgtttgggctgtcgctgtggctggttctgcggtgtgcggccagccatggagcgctctgggcccagcgaagtgacaggctcagacgcatcgggaccggacccgcagcttgtggtcaccatgggcttcacggggttcggggttcggtaaaaaagctcacacatttgacttggaagcaatgtttgaacaaactcaaagaacagctgtggaaagaagtcacaaaacactggaccagattacagaggggtattgatttgccttgcccccgcccccaccatcacagtgtgtccctgtccagtgttggtgctgtgtggcattgcttgtgtccataggagtccatcaaggcagagcggcagagcggcaagcagagcggcaaggcaggtcagcttccggctcttccaggctgcatgtccccctcaatatcctttcaacccaatggaaatggattgaaagagtgaaagtcactggtctcaaagaatctacggaatttagcattttgaaaatcacagagcaattttgggtaggtattcacatgcactaaaaaaccaggcaaacatctgactcccaggataaagtgactgagagcagtagaagacttgttgagccttaaggaataagaggaaaattatgttatgaagtgcaggaacagcacagacccagacgaggggatgcagcccggagccagtaacccggcgcctcctcctccccagggcgcagcgctggctgctccccggataccgtgatcacacgtcccaggtcctgagagcgcctcataggtagacagttctttgggacttttgggacgcagcacttgaagagaggtttacctaaactttcctcctgggagcctgtcatcatttgaaagtaacagaagaaagctgtcaggctgaggaaagtttcaacaggcacttggtgagaatgggaagcatccattcattgggaaatcacggggacagaggaggaattcacgggatcagagcactgagaaactccagaggcttctggttcaccgccctgattccacagatgtgggtcagaggcagagatggaagttggaatggacaagcctgccctctcctcagctctccatggctctgtcctcaggctgtttctgcaatttgacatgaggcctggccccagggaaaccagtggggcctcatctcctccctgtgctgctctgaggtggagccttctcagggtcagtccagctctggagcccctctccagctcggtcaccaaagctgtctggtcccagggcagtgtggagtgacaggcacgccagccaatccaatcggccatttcatacccaatgcatgtgactgataaagagataacaccctgtctccaagacacaggctttacataaacagctttaatgacttcttcacttagggacaagactccttagtggtggaacctcaggcatccatgcaggatgtaagaaagctcccgtatatacatgaactgagaagtgtgtagaagagtaaatactgtaataggtaataaaatgtatgtatttttatttatgtgctactttgtctttctccctctctgtgtatatacacatacatacaaaaatgtattcattctatggaaaacatgaaagatgtaatattctttacatatttaattaatgtattttttctgatcatatgaacaccacaaatataattttataatttttttacctaacaataagtcttaaacataaatatacatggacaatatcatagttttttttttaatcataattaaaatggttgtgaaacattccact

SEQ ID NO: 291043 - DNA, 1914 bp, Homo sapiens
cccacgcgtacgcccacgcgtccgggccagccatggagcgctctgggcccagcgaagtgacaggctcagacgcatcgggaccggacccgcagcttgtggtcaccatgggcttcacggggttcggggttcggtaaaaaagctcacacatttgacttggaagcaatgtttgaacaaactcaaagaacagctgtggaaagaagtcacaaaacactgggccaccaggaacacacctgtagcccagcaaagttgaggccatcgactggctcatcacaacaaggaaggctgtgcaccactgggacccagcagcagctcagcagcagcagtgagagggccttgggaaagacttggagggtttggcttatacaagaccagattacagaggggtattgatttgccttgcccccgcccccaccatcacagtgtgtccctgtccagtgttggtgctgtgtggcattgcttgtgtccataggagtccatcaaggcagagcggcagagcggcaagcagagcggcaaggcaggtcagcttccggctcttccaggctgcatgtccccctcaatatcctttcaacccaatggaaatggattgaaagagtgaaagtcactggtctcaaagaatctacggaatttagcattttgaaaatcacagagcaattttgggtaggtattcacatgcactaaaaaaccaggcaaacatctgactcccaggataaagtgactgagagcagtagaagacttgttgagccttaaggaataagaggaaaattatgttatgaagtgcaggaacagcacagacccagacgaggggatgcagcccggagccagtaacccggcgcctcctcctccccagggcgcagcgctggctgctccccggataccgtgatcacacgtcccaggtcctgagagcgcctcataggtagacagttctttgggacttttgggacgcagcacttgaagagaggtttacctaaactttcctcctgggagcctgtcatcatttgaaagtaacagaagaaagctgtcaggctgaggaaagtttcaacaggcacttggtgagaatgggaagcatccattcattgggaaatcacggggacagaggaggaattcacgggatcagagcactgagaaactccagaggcttctggttcaccgccctgattccacagatgtgggtcagaggcagagatggaagttggaatggacaagcctgccctctcctcagctctccatggctctgtcctcaggctgtttctgcaatttgacatgaggcctggccccagggaaaccagtggggcctcatctcctccctgtgctgctctgaggtggagccttctcagggtcagtccagctctggagcccctctccagctcggtcaccaaagctgtctggtcccagggcagtgtggagtgacaggcacgccagccaatccaatcggccatttcatacccaatgcatgtgactgataaagagataacaccctgtctccaagacacaggctttacataaacagctttaatgacttcttcacttagggacaagactccttagtggtggaacctcaggcatccatgcaggatgtaagaaagctcccgtatatacatgaactgagaagtgtgtagaagagtaaatactgtaataggtaataaaatgtatgtatttttatttatgtgctactttgtctttctccctctctgtgtatatacacatacatacaaaaatgtattcattctatggaaaacatgaaagatgtaatattctttacatatttaattaatgtattttttctgatcatatgaacaccacaaatataattttataatttttttacctaacaataagtcttaaacataaatatacatggacaatatcatagttttttttttaatcataattaaaatggttgtgaaacattccact

SEQ ID NO: 291044 - DNA, 1708 bp, Homo sapiens
ctgcagttgtttgggctgtcgctgtggctggttctgcggtgtgcggccagccatggagcgctctgggcccagcgaaggtaaaaaagctcacacatttgacttggaagcaatgtttgaacaaactcaaagaacagctgtggaaagaagtcacaaaacactggaccagattacagaggggtattgatttgccttgcccccgcccccaccatcacagtgtgtccctgtccagtgttggtgctgtgtggcattgcttgtgtccataggagtccatcaaggcagagcggcagagcggcaagcagagcggcaaggcaggtcagcttccggctcttccaggctgcatgtccccctcaatatcctttcaacccaatggaaatggattgaaagagtgaaagtcactggtctcaaagaatctacggaatttagcattttgaaaatcacagagcaattttgggtaggtattcacatgcactaaaaaaccaggcaaacatctgactcccaggataaagtgactgagagcagtagaagacttgttgagccttaaggaataagaggaaaattatgttatgaagtgcaggaacagcacagacccagacgaggggatgcagcccggagccagtaacccggcgcctcctcctccccagggcgcagcgctggctgctccccggataccgtgatcacacgtcccaggtcctgagagcgcctcataggtagacagttctttgggacttttgggacgcagcacttgaagagaggtttacctaaactttcctcctgggagcctgtcatcatttgaaagtaacagaagaaagctgtcaggctgaggaaagtttcaacaggcacttggtgagaatgggaagcatccattcattgggaaatcacggggacagaggaggaattcacgggatcagagcactgagaaactccagaggcttctggttcaccgccctgattccacagatgtgggtcagaggcagagatggaagttggaatggacaagcctgccctctcctcagctctccatggctctgtcctcaggctgtttctgcaatttgacatgaggcctggccccagggaaaccagtggggcctcatctcctccctgtgctgctctgaggtggagccttctcagggtcagtccagctctggagcccctctccagctcggtcaccaaagctgtctggtcccagggcagtgtggagtgacaggcacgccagccaatccaatcggccatttcatacccaatgcatgtgactgataaagagataacaccctgtctccaagacacaggctttacataaacagctttaatgacttcttcacttagggacaagactccttagtggtggaacctcaggcatccatgcaggatgtaagaaagctcccgtatatacatgaactgagaagtgtgtagaagagtaaatactgtaataggtaataaaatgtatgtatttttatttatgtgctactttgtctttctccctctctgtgtatatacacatacatacaaaaatgtattcattctatggaaaacatgaaagatgtaatattctttacatatttaattaatgtattttttctgatcatatgaacaccacaaatataattttataatttttttacctaacaataagtcttaaacataaatatacatggacaatatcatagttttttttttaatcataattaaaatggttgtgaaacattccact

SEQ ID NO: 291045 - DNA, 1736 bp, Homo sapiens
ctgcagttgtttgggctgtcgctgtggctggttctgcggtgtgcggccagccatggagcgctctgggcccagcgaagtgacaggctcagacgcatcgggaccggacccgcagcttgtggtcaccatgggcttcacggggttcggggttcggtaaaaaagctcacacatttgacttggaagcaatgtttgaacaaactcaaagaacagctgtggaaagaagtcacaaaacactggaccagattacagaggggtattgatttgccttgcccccgcccccaccatcacagtgtgtccctgtccagtgttggtgctgtgtggcattgcttgtgtccataggagtccatcaaggcagagcggcagagcggcaagcagagcggcaaggcagttcaacccaatggaaatggattgaaagagtgaaagtcactggtctcaaagaatctacggaatttagcattttgaaaatcacagagcaattttgggtaggtattcacatgcactaaaaaaccaggcaaacatctgactcccaggataaagtgactgagagcagtagaagacttgttgagccttaaggaataagaggaaaattatgttatgaagtgcaggaacagcacagacccagacgaggggatgcagcccggagccagtaacccggcgcctcctcctccccagggcgcagcgctggctgctccccggataccgtgatcacacgtcccaggtcctgagagcgcctcataggtagacagttctttgggacttttgggacgcagcacttgaagagaggtttacctaaactttcctcctgggagcctgtcatcatttgaaagtaacagaagaaagctgtcaggctgaggaaagtttcaacaggcacttggtgagaatgggaagcatccattcattgggaaatcacggggacagaggaggaattcacgggatcagagcactgagaaactccagaggcttctggttcaccgccctgattccacagatgtgggtcagaggcagagatggaagttggaatggacaagcctgccctctcctcagctctccatggctctgtcctcaggctgtttctgcaatttgacatgaggcctggccccagggaaaccagtggggcctcatctcctccctgtgctgctctgaggtggagccttctcagggtcagtccagctctggagcccctctccagctcggtcaccaaagctgtctggtcccagggcagtgtggagtgacaggcacgccagccaatccaatcggccatttcatacccaatgcatgtgactgataaagagataacaccctgtctccaagacacaggctttacataaacagctttaatgacttcttcacttagggacaagactccttagtggtggaacctcaggcatccatgcaggatgtaagaaagctcccgtatatacatgaactgagaagtgtgtagaagagtaaatactgtaataggtaataaaatgtatgtatttttatttatgtgctactttgtctttctccctctctgtgtatatacacatacatacaaaaatgtattcattctatggaaaacatgaaagatgtaatattctttacatatttaattaatgtattttttctgatcatatgaacaccacaaatataattttataatttttttacctaacaataagtcttaaacataaatatacatggacaatatcatagttttttttttaatcataattaaaatggttgtgaaacattccact

SEQ ID NO: 291046 - DNA, 945 bp, Homo sapiens
cccacgcgtacgcccacgcgtccgggccagccatggagcgctctgggcccagcgaagtgacaggctcagacgcatcgggaccggacccgcagcttgtggtcaccatgggcttcacggggttcggggttcggtaaaaaagctcacacatttgacttggaagcaatgtttgaacaaactcaaagaacagctgtggaaagaagtcacaaaacactggaccagattacagaggggtattgatttgccttgcccccgcccccaccatcacagtgtgtccctgtccagtgttggtgctgtgtggcattgcttgtgtccataggagtccatcaaggcagagcggcagagcggcaagcagagcggcaaggcaggtcagcttccggctcttccaggctgcatgtccccctcaatatcctttcaacccaatggaaatggattgaaagagtgaaagtcactggtctcaaagaatctacggaatttagcattttgaaaatcacagagcaattttgggtaggtattcacatgcactaaaaaaccaggcaatttgacatgaggcctggccccagggaaaccagtggggcctcatctcctccctgtgctgctctgaggtggagccttctcagggtcagtccagctctggagcccctctccagctcggtcaccaaagctgtctggtcccagggcagtgtggagtgacaggcacgccagccaatccaatcggccatttcatacccaatgcatgtgactgataaagagataacaccctgtctccaagacacaggctttacataaacagctttaatgacttcttcacttagggacaagactccttagtggtggaacctcaggcatccatgcaggatgtaagaaagctcccgtatatacatgaactgagaagtgtgtagaagagtaaatactgtaataggtaataaaatgtatgtatttttattt

SEQ ID NO: 291047 - DNA, 969 bp, Homo sapiens
ctgcagttgtttgggctgtcgctgtggctggttctgcggtgtgcggccagccatggagcgctctgggcccagcgaagtgacaggctcagacgcatcgggaccggacccgcagcttgtggtcaccatgggcttcacggggttcggggttcggtaaaaaagctcacacatttgacttggaagcaatgtttgaacaaactcaaagaacagctgtggaaagaagtcacaaaacactggggctggtgaattaccagatctccatcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaacgtcacctatgcagcagacaagggggctctgtatgtggatgtgatccgtgtgaacagctactactcttggtatcgcaactacgggcacctggagttgattcagctgcagctggccacccagtttgagaattggtgtaagacatcacaatcccattattcagagcgcgtatggagtggaaacgcttgtagggtttcaccagttctgcaggctggaaatccaagatgaagtcacctgtagttcagtgtctgcgtctaagagagcactttgttgctgcacccgccagagggaagaaatactgtatcttctcatgaaggaaggaaccgaaggtgggaatagggaccaacctccctttttcaagcctttttgtagtgacattaattcatttatgaggattccaccatcatgacataatcatttcccaaaggatttcacctcctcccactgttgcattggggattaattttccaacacatgaattttgaggga

SEQ ID NO: 291048 - DNA, 374 bp, Homo sapiens
tagggtagggatctagaggaggatgggaaagttgcctggttaatagtacttagtgaagggattgtcatcagaagttttctgtgactcaaactccttctgtgatattttatggttatattggagccatgctataaactagacaaagtaagtgtttattgatcagtattgatcacctaaagtttggccaacttactgcaagacaatcacagtctcccatttgttcatgttttaggtaaaaaagctcacacatttgacttggaagcaatgtttgaacaaactcaaagaacagctgtggaaagaagtcacaaaacactgggtaagaagttcagatatttgtcgttttattggtttaagtactatttatacctcatgca

SEQ ID NO: 291049 - DNA, 111 bp, Homo sapiens
cacaaaggtctagacttagataaaaccttctgtattgggaagtaattgtcatttcttggattaagacagctatgctcttgctcacagggcagaaagttatttctcaagaag

SEQ ID NO: 291050 - DNA, 944 bp, Homo sapiens
caggtgcggccgcgaccgtgggcggtggggcaggtgggtcaggcggcgcgtgccctgtcccctccccgggctccggccacacgagcgggccggcgctgcgctgctggcaacgtgtcgcgggaacgctcctaccccatctgcatgccttacatggctcgaaagtaaaaataaaaagaattacgctgcgggcgaggcttgtgggggtgagaagaggagattccacgtctccccagtgctgcgtcctgataggacccccagggccttccgagccctctcccagcgaccacctcgtgtcccggagttgcagcaagagatgtgagaaggtgtcaccctgaagaggaagtggtggaccagccctgcctgatgtggacagcaggggacacatgtctgcctgtcggtctatctgaaatgggggaaaaaatgctgaaagccaaaggagggcttaatgtggccttttccaccttctaattccatagaacctcagctctgggacttgcttcctgacctagggtgcaggggccaaatttgtttgggaacaaccccattcacaattccccatgaactttcagaaaggacccttgcgtcttaggtcctgagaagtcacaaataagcaagctgcattgtctaatgtcttgtctacactgttttacaaacacatttaacagccgaattgtatatgtgccctagaaatcactttgagaaacacttatttcctgatagaggacttgatgggaccattctgcagccccatctgagcatgggctggagagtacataagtatctgggagctggaagtcctcaattccaggcttatctgcccccatcagcgtgggacctcagttcctcctccaaggagaagagcgcccctcccttgatgttttgtgcattcttttgctaaatgtttctctggtcaagaactttaatccccctacaaaaaaaatgta

SEQ ID NO: 291051 - DNA, 1065 bp, Homo sapiens
cgagcggcgagaaattgtttccactgcaaacaaaaaaaggcgacacatgaccaggcaggaggaggggaagcgcggggagggaggagggcggagggagggacagagcggagggcggagggagccggagaaagggaaaacgtgggcggtggggcaggtgggtcaggcggcgcgtgccctgtcccctccccgggctccggccacacgagcgggccggcgctgcgctgctggcaacgtgtcgcgggaacgctcctaccccatctgcatgccttacatggctcgaaagtaaaaataaaaagaattacgctgcgggcgaggcttgtgggggtgagaagaggagattccacgtctccccagtgctgcgtcctgataggacccccagggccttccgagccctctcccagcgaccacctcgtgtcccggagttgcagcaagagatgtgagaaggtgtcaccctgaagaggaagtggtggaccagccctgcctgatgtggacagcaggggacacatgtctgcctgtcggtctatctgaaatgggggaaaaaatgctgaaagccaaaggagggcttaatgtggccttttccaccttctaattccatagaacctcagctctgggacttgcttcctgacctagggtgcaggggccaaatttgtttgggaacaaccccattcacaattccccatgaactttcagaaaggacccttgcgtcttaggtcctgagaagtcacaaataagcaagctgcattgtctaatgtcttgtctacactgttttacaaacacatttaacagccgaattgtatatgtgccctagaaatcactttgagaaacacttatttcctgatagaggacttgatgggaccattctgcagccccatctgagcatgggctggagagtacataagtatctgggagctggaagtcctcaattccaggcttatctgcccccatcagcgtgggacctcagttcctcctccaaggagaagagcgcccctcccttgatgttttgtgcattcttttgctaaatgtttctctggtcaagaactttaatccccctacaaaaaaaatgta

SEQ ID NO: 291052 - DNA, 671 bp, Homo sapiens
cgagcggcgagaaattgtttccactgcaaacaaaaaaaggcgacacatgaccaggcaggaggaggggaagcgcggggagggaggagggcggagggagggacagagcggagggcggagggagccggagaaagggaaaacgtgggcggtggggcaggtgggtcaggcggcgcgtgccctgtcccctccccgggctccggccacacgagcgggccggcgctgcgctgctggcaacgtgtcgcgggaacgctcctaccccatctgcatgccttacatggctcgaaagtaaaaataaaaagaattacgctgcgggcgaggcttgtgggggtgagaagaggagattccacgtctccccagtgctgcgtcctgataggacccccagggccttccgagccctctcccagcgaccacctcgtgtcccggaggtaagcaccgcagcgtcccacccaggtggccgcgtgtctcccgagggagggccggtggccattacaagacaagaggcaccgtcctaaaggccacgccggtggggcctctcaagtgggttgtgcggaacgccccggccggcctagagagaaaacaggtctcatttccatctcagtttgagctctcaggaaccagactgacaattcgcaagccacccagcgaaatggtgcagccaccactctaagtctcta

SEQ ID NO: 291053 - DNA, 523 bp, Homo sapiens
cgcaggtgaggcactgccctggcgctaggccggcaactggggtcggtgcgcgcgtgagcgcgttcgcgttcgaggtcccggctctaaggtgggggctgcacctccccctgcacgagcaggtgtgtaggattcaagagccagcgcaccacactgttctttctttctcacttctccccaagccagcattgaacttctttgcagttttattgagtcagaacttcaagtaggggttccccatattttaaactcttttctctgtggtatttgtcctgtaccagagtttttctctgaggtatatcctgtttatacctgtttacgtccaagagctcttcttttctctcaaaagacccttaaccctggataggaatcgattggccaacttaaaaaatttgctatggtttaggttggaagttttggcagacaaagcacagtaaaactggccactaaattgtgtctgaaacttactcatcaaaatagtgtgaataaaaacttatatgaatggtggtaatcttggaggtacatg

SEQ ID NO: 291054 - DNA, 1875 bp, Homo sapiens
cggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291055 - DNA, 1907 bp, Homo sapiens
cggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatgggatgattgctgagtgtcctggggccccagcagcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291056 - DNA, 1697 bp, Homo sapiens
agcctggcgcgcgctaattgcctattggcctgtgctgccggctcgcagcccgggtggacccgagccacgccccctggagtgcgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatgagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291057 - DNA, 1811 bp, Homo sapiens
cggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatgagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291058 - DNA, 383 bp, Homo sapiens
agccttttggagggttgattgatggggcagatacttgaggcaggatgaaagctctacagcattccaggctaagcctagctagatcagtagagtcggggaaagggagagaggacaaggagaggattctctgctccccctcccccaactacaaggcctccctccttccattttttcacagggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291059 - DNA, 501 bp, Homo sapiens
  misc_feature (14)..(14): n is a, c, g, or t
  misc_feature (18)..(18): n is a, c, g, or t
  misc_feature (20)..(20): n is a, c, g, or t
  misc_feature (25)..(26): n is a, c, g, or t
gcgggccccgcccncccncncctcnncttccaacctttctttttttccctctcccaccattccgccggagttgacaccaccacgcgtgtcacggctcacagccagggacctgtatgtagagacagggtttcaccatgttgactaggctggtctcgaactcctgacctcaagtgatctgcccatcttggcctcccaaagtgctgggattacaggcgtgagccaccacacccatccatgggagctatcagttctaattgggagacggatcaggaaaggctgtttggaggaagcagctgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291060 - DNA, 2048 bp, Homo sapiens
cggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtggtgagcaccaaacctagcccccaccccaacccttcctggcccagtcagaagccccattccagttcttcctctaacctgagtaagattctgcagaacccggccaaagcccactctctaggttggcccctaaagccctcttggcttgagtagggttcggggatctccgttcccagctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291061 - DNA, 1898 bp, Homo sapiens
cggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgggttcggggatctccgttcccagctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291062 - DNA, 2126 bp, Homo sapiens
cggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctggtcagtacatctcctgagagcagggccactttgcctcgaggcccttgggtctgggggctgtgggccaggtaggggcaggtcagcagtgtcctcatgccaacccctttcccccagtgtgggtctcagaggtcatgctgcagcagacccaggttgccactgtgatcaactactataccggatggatgcaggtgactccaggggaggaagggaagggtcatgggtcagaccccagatgagagcctctactttggggtgggtgtagagaaggcttcctctaccaccttcacccttgaccttgtctctttctgcctgcctgtggctatagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291063 - DNA, 2284 bp, Homo sapiens
cggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctggtcagtacatctcctgagagcagggccactttgcctcgaggcccttgggtctgggggctgtgggccaggtaggggcaggtcagcagtgtcctcatgccaacccctttcccccagtgtgggtctcagaggtcatgctgcagcagacccaggttgccactgtgatcaactactataccggatggatgcaggtgactccaggggaggaagggaagggtcatgggtcagaccccagatgagagcctctactttggggtgggtgtagagaaggcttcctctaccaccttcacccttgaccttgtctctttctgcctgcctgtggctatagaagtggcctacactgcaggacctggccagtgcttccctggaggtgagagccaccctagggtaggggaaataggaacgatagagggactgacgggtgatctctttgacctctgatcctacccacaggaggtgaatcaactctgggctggcctgggctactattctcgtggccggcggctgcaggagggagctcggaaggtaaggggatggcaggagggtaggaacccaggagtcttgggtgtcttataatcttgagtcttgcactccaatcaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291064 - DNA, 2268 bp, Homo sapiens
cggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcaggtgactccaggggaggaagggaagggtcatgggtcagaccccagatgagagcctctactttggggtgggtgtagagaaggcttcctctaccaccttcacccttgaccttgtctctttctgcctgcctgtggctatagaagtggcctacactgcaggacctggccagtgcttccctggaggtgagagccaccctagggtaggggaaataggaacgatagagggactgacgggtgatctctttgacctctgatcctacccacaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtggtgagcaccaaacctagcccccaccccaacccttcctggcccagtcagaagccccattccagttcttcctctaacctgagtaagattctgcagaacccggccaaagcccactctctaggttggcccctaaagccctcttggcttgagtagggttcggggatctccgttcccagctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291065 - DNA, 2135 bp, Homo sapiens
cggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcagaagatgagatggacctggacaggcgggcatatgctggtcagtacatctcctgagagcagggccactttgcctcgaggcccttgggtctgggggctgtgggccaggtaggggcaggtcagcagtgtcctcatgccaacccctttcccccagtgtgggtctcagaggtcatgctgcagcagacccaggttgccactgtgatcaactactataccggatggatgcaggtgactccaggggaggaagggaagggtcatgggtcagaccccagatgagagcctctactttggggtgggtgtagagaaggcttcctctaccaccttcacccttgaccttgtctctttctgcctgcctgtggctatagaagtggcctacactgcaggacctggccagtgcttccctggaggtgagagccaccctagggtaggggaaataggaacgatagagggactgacgggtgatctctttgacctctgatcctacccacaggaggtgaatcaactctgggctggcctgggctactattctcgtggccggcggctgcaggagggagctcggaaggtaaggggatggcaggagggtaggaacccaggagtcttgggtgtcttataatcttgagtcttgcactccaatcaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291066 - DNA, 1449 bp, Homo sapiens
cggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291067 - DNA, 1004 bp, Homo sapiens
gggtaacaagggtgcttcaggggtgtctgcaaaggagctctgcttcacagcagtgttcccttcttttaggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291068 - DNA, 1821 bp, Homo sapiens
cggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaccactgatgcacacagcctcaacagtgcagcccagtgacacctctgaaagcccccattccctgagaatcctgttgttagtaaagtgcttatttttgtagttaaaaaaagtt

SEQ ID NO: 291069 - DNA, 1713 bp, Homo sapiens
cggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtatgtatcaggcacaacaagctacagactctgtactagaatacggtttcaccactgtcatctcgcatcgtctcgact

SEQ ID NO: 291070 - DNA, 1761 bp, Homo sapiens
agcctggcgcgcgctaattgcctattggcctgtgctgccggctcgcagcccgggtggacccgagccacgccccctggagtgcgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291071 - DNA, 1701 bp, Homo sapiens
cgcggcgggaacgcggggcctccgtgttctgctgtcttcatcagcgtgggccgcgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291072 - DNA, 1843 bp, Homo sapiens
cgcggcgggaacgcggggcctccgtgttctgctgtcttcatcagcgtgggccgcggtgtgtacagtttacctggcactgactttggacacacaccaatcaacaagagaatcagtccttgcactcaagtcgttttttacagtcaaattcaggaagtacacactgatggaaagaatcaaagtaatgtaaaattacattaggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291073 - DNA, 1733 bp, Homo sapiens
cgcggcgggaacgcggggcctccgtgttctgctgtcttcatcagcgtgggccgcgggccatcatgaggaagccacgagcagccgtgggaagtggtcacaggaagcaggcagccagccaggaagggaggcagaagcatgctaagaacaacagtcaggccaagccttctgcctgtgatgggatgattgctgagtgtcctggggccccagcagcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291074 - DNA, 321 bp, Homo sapiens
  misc_feature (14)..(14): n is a, c, g, or t
  misc_feature (18)..(18): n is a, c, g, or t
  misc_feature (20)..(20): n is a, c, g, or t
  misc_feature (25)..(26): n is a, c, g, or t
gcgggccccgcccncccncncctcnncttccaacctttctttttttccctctcccaccattccgccggagttgacaccaccacgcgtgtcacggctcacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291075 - DNA, 1950 bp, Homo sapiens
cggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtaaggggatggcaggagggtaggaacccaggagtcttgggtgtcttataatcttgagtcttgcactccaatcaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291076 - DNA, 2170 bp, Homo sapiens
cggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcaggtgactccaggggaggaagggaagggtcatgggtcagaccccagatgagagcctctactttggggtgggtgtagagaaggcttcctctaccaccttcacccttgaccttgtctctttctgcctgcctgtggctatagaagtggcctacactgcaggacctggccagtgcttccctggaggtgagagccaccctagggtaggggaaataggaacgatagagggactgacgggtgatctctttgacctctgatcctacccacaggaggtgaatcaactctgggctggcctgggctactattctcgtggccggcggctgcaggagggagctcggaaggtaaggggatggcaggagggtaggaacccaggagtcttgggtgtcttataatcttgagtcttgcactccaatcaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291077 - DNA, 2027 bp, Homo sapiens
cgcggcgggaacgcggggcctccgtgttctgctgtcttcatcagcgtgggccgcgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctggtcagtacatctcctgagagcagggccactttgcctcgaggcccttgggtctgggggctgtgggccaggtaggggcaggtcagcagtgtcctcatgccaacccctttcccccagtgtgggtctcagaggtcatgctgcagcagacccaggttgccactgtgatcaactactataccggatggatgcaggtgactccaggggaggaagggaagggtcatgggtcagaccccagatgagagcctctactttggggtgggtgtagagaaggcttcctctaccaccttcacccttgaccttgtctctttctgcctgcctgtggctatagaagtggcctacactgcaggacctggccagtgcttccctggaggaggtgaatcaactctgggctggcctgggctactattctcgtggccggcggctgcaggagggagctcggaaggtaaggggatggcaggagggtaggaacccaggagtcttgggtgtcttataatcttgagtcttgcactccaatcaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291078 - DNA, 1930 bp, Homo sapiens
agcctggcgcgcgctaattgcctattggcctgtgctgccggctcgcagcccgggtggacccgagccacgccccctggagtgcgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatgggatgattgctgagtgtcctggggccccagcagcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcaggtgactccaggggaggaagggaagggtcatgggtcagaccccagatgagagcctctactttggggtgggtgtagagaaggcttcctctaccaccttcacccttgaccttgtctctttctgcctgcctgtggctatagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291079 - DNA, 1645 bp, Homo sapiens
agcctggcgcgcgctaattgcctattggcctgtgctgccggctcgcagcccgggtggacccgagccacgccccctggagtgcgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291080 - DNA, 1265 bp, Homo sapiens
cggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaagtt

SEQ ID NO: 291081 - DNA, 345 bp, Homo sapiens
gctggcaggactgtgggagttcccgtccgtgacctgggagccctcagagcagcttcagcgcaaggccctgctgcaggaactacagcgttgggctgggcccctcccagccacgcacctccggcaccttggggaggtaagtgagcagcggaatagccaaggatgttggcttttgaggctatatccacaggcctatttgaaccccttgacccttcctccaggttgtccacaccttctctcacatcaagctgacatatcaagtatatgggctggccttggaagggcagaccccagtgaccaccgtaccaccaggtgctcgctggctgacgcaggaggaatttcacaccg

SEQ ID NO: 291082 - DNA, 782 bp, Homo sapiens
aaaaaaaaaaaaaggatctctcagctgttgggcctgagatgatatgtctcaacctgggcaccatgacagaagaaacttgtggcatctgactgtgagattagtccacgcctgggctctgcgttcatgggcagggcacaccctagtgctgttgaagcaggtacatcagaggccgcatgacagctttgccttttgctctccagggtgggcagcaggtgggcccagcggggagagagttgtcttgggggttgataaggaggcctggttgtagagattctctccgtaccattttgctgaaagagtttggttaactttttgaaaacaatttaaaaattgtagacatgtgccatagaacctaaaaaaatatgctcgtggcagatagtaaaatgataagggctctaagaacatttttagaatagatagcagtatgactttatccctacttctaacattctttcccctgaaactacacagacattcattcagcatatgaagttttcaggctgggtgcaatggctcatgcctgtaatcccagtactttgggaggttgtggcgggaggattgcttaagcctgagagttcaagaccagcctgggcaacatagggagaccttgtctctacagaaaaagtttaaaattagctgagcgtggtgctgtgcatgtgtggtcccaggtactcggcaggccgaggagggaggatcgcttgggcacagcaggtcgaggctgcagtgagccatgattacaccactgcactccagctgggccacagagtgagaccctgtatcaa

SEQ ID NO: 291083 - DNA, 435 bp, Homo sapiens
cggccgcaggtggaaagtaattctgcgtttccatttctctttccagaaaaataacgtggagcaagtggtaagagccctccccaccacccccagccgtgagtctgcacacgtccacccacacgtccacctgtgtgttcaggacgcatgtccctatgcatatccgcccatgtgcccgggacacatgtcccctgcgtgtctgcccgtgtgcccgggatgtgtgtccccctgcgtgtccacctgtgtgtctgcccatgtgcctgggacatgtgtccgcctgtgcgtccatccgtgtgtccgtctgcccatgtgcctgggtcgcatgtcaccctgtgtcccagccgtatgtccgtggctttcccactgactcgtctccatgctttccccccacagtgctgctccttcgaatgccagcctgcaagaggacctccggggctc

SEQ ID NO: 291084 - DNA, 756 bp, Homo sapiens
agcggaaatggtgccagacgtggtggtatgagcctgtaattccagccactcaggaggctgaggtgggaggatcactctggcctaggagtttgagatcagcctgggtgacagagcaagaccctgtctctagaaaagagaaagaataaatggctgatggagatgactctactgcaaaaatgacaaccagcaagaaagcgggtggtgcccgtttcctccctggggaccctcagagggccaggccattctcttccttggtgtgactgcggatccagggcccagctgaagagcatcagatctgtgggcatgttgcaccagtgaatgttggagaagtacttgttggacacacatgttcctccatttagacagtcacagttcgctggagagaacaaagccaactgttgtaggggtggatactcacatggaacttgatgaagttcattgctgccctggaagagattcgggaggaggcttcatcaaaggtcccatgctccagggactccagggtgagggtaaactggccccaatcccaaaacccactcttccctctccctctcgcctcaccctgttcgtatctagttctcaaatggaagaccatgggtttccagccaggagaaatggattgacccaagcaagcttcatctaccagatgcccgcaggctggggcagtcccggcggcctcttcctcccttgccagccagtgccaacccccgtggttctcaagcctccgctgccaccctgtcccatttcctggggaga

SEQ ID NO: 291085 - DNA, 2032 bp, Homo sapiens
ggctcactgcatctccggctcctggactcaagcgattctcctgcctcaggctcccaaggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaatgcacagtgaagggtgatttgtggggagggagcatttttggtggtcttgggggaggggaggggagggaagggctggtgttgattttcctccctgcagagccaatggtgcacattggtttaagcccagagatcctgcttgagccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctcccc

SEQ ID NO: 291086 - DNA, 2117 bp, Homo sapiens
ggacgctcggcggagccagggagtccggcgagtcgctgggggaagtcgagcagacacccagcgctgccggaactcggggcgcgcatcccgcaagtcggaacccggcggatcggatcccgcagatcggagacggggcctggagggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaatgcacagtgaagggtgatttgtggggagggagcatttttggtggtcttgggggaggggaggggagggaagggctggtgttgattttcctccctgcagagccaatggtgcacattggtttaagcccagagatcctgcttgagccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctcccc

SEQ ID NO: 291087 - DNA, 2130 bp, Homo sapiens
ggacgctcggcggagccagggagtccggcgagtcgctgggggaagtcgagcagacacccagcgctgccggaactcggggcgcgcatcccgcaagtcggaacccggcggatcggatcccgcagatcggagacggggcctggagggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtaaggggtcaggagtggctgctgagtttcatgagcatccagtatttcctgctgtagctgccacatgttgctaggtactcagcaatattttgtgtggggggcaggtggtacacaggtctgaaaacagcgtgaatgctctttctccaaagaagagaacattacaaatgggatttctttatccatttatttactcaacaagcgttcactgaggaggtgagttgtaagtggacactggagacagttacagtgatgatgaagaccatcagagccccttccttcaggaagcatgcagtgtagcaggaaggcatggctttacacatggcatttcacaaccaatccattgcaattttaagtcctgggaaggagaaaacgcagctaagagagcagatagctgcagcagttggtgagggtaggaaatcagggcaggctcccttgaggaagtagcattttaccctaagtcttgacaaacagggattggctgggtgaagaaggtaaggaagagcattctgggcggagggaagggtgcatgcgatggcctgaggtgggatggagcttacagaggtggt

SEQ ID NO: 291088 - DNA, 781 bp, Homo sapiens
ggctcactgcatctccggctcctggactcaagcgattctcctgcctcaggctcccaaggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgacacgaagcttggagtagaactgctggccatgtacagctcctgcagatcctgccagacagttctccaaatcgatcgcaccaactccactcccacagccgggggagggttccagtcttgccacatcctcgccaacacggggtatcactggaagatttttctttgactcagagagtaacatacttatccacacatgacaaggaacttgatcccagaaagaaatctaagaaaggcagaaggaacaaagacccaatcctggtcagaaaaggggtccctagccctaaaacgtacttcactttaaataaacagagttggagct

SEQ ID NO: 291089 - DNA, 563 bp, Homo sapiens
  misc_feature (37)..(37): n is a, c, g, or t
cctgggtgccagtccatctcaagtgccatattctgtnatcacggatgttggctccccctcgccctatgcaagcaaacacacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaatgcacagtgaagggtgatttgtggggagggagcatttttggtggtcttgggggaggggaggggagggaagggctggtgttgattttcctccctgcagagccaatggtgcacattggtttaagcccagagatcctgcttgagccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctcccc

SEQ ID NO: 291090 - DNA, 1234 bp, Homo sapiens
ggacgctcggcggagccagggagtccggcgagtcgctgggggaagtcgagcagacacccagcgctgccggaactcggggcgcgcatcccgcaagtcggaacccggcggatcggatcccgcagatcggagacggggcctggagggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggagccagtttccacaggcagcatcccaaggttcaataaggccttatttaacaagcaa

SEQ ID NO: 291091 - DNA, 886 bp, Homo sapiens
ggctcactgcatctccggctcctggactcaagcgattctcctgcctcaggctcccaaggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggtgagttgagcacacctgaaatgcagaggctgtgcattttttctgcaattacgaagagagccgaggcaattacctggttgatgtggacggcaaccgaatgctggatctttattcccagatctcctctgtccccatagagtctcactgtcacccaggctggagtgcagtggcgtgatctcaactcaatgcaacctccgcctcttgtgttcaagagattcttctgcctcagccccccgagtacctgggattacaggttacagccaccccgccctgctgaaactcatccaacagcctcaaaatgcgacacgaagcttggagtagaactgctggccatgtacagctcctgcagatcctgccagacagttctccaaatcgatcgcaccaactccactcccacagccgggggagggttccagtcttgccacatcctcgccaacacggggtatcactggaagatttttctttgactcagagagtaacatacttatccacacatgacaaggaacttgatcccagaaagaaatctaagaaaggcagaaggaacaaagacccaatcctggtcagaaaaggggtccctagccctaaaacgtacttcactttaaataaacagagttggagct

SEQ ID NO: 291092 - DNA, 2767 bp, Homo sapiens
agtttcagccgcgacagcaagaacggcagagccggcgaccgcggcggcggcgacggcggaggcaggagcagcctgggcgggtcgcagggtctccgcgggcgcaggaaggcgagcagagcacaaatgaggatgtcccaatttctgccttttgggttttaccagctgctgtaggttttccacactgagtagttgcagtagactggctgccctctgtccaacatgcaatgccacttggtatcattcatggtttgatcccgagaacaatccacctattatataattttcccctcacatgtcattccactgacctcaatcaactgatgtggtgatgaaatgaaacacgttcatggagaagctgagaaaagtgtgcaaagtacacctacaaggagagtttccccatgttttccataatgtggccatccaggatgaggaaggaacaagaatacttgaacatcacagagaccaaaccatttccatacgtcaaaaccagagagcctgggatcaaagttatacttggaaaagggctgtaagaaatgaaaaaccacctagcagcatctgtacttcccttaaaatccaacctccactggcttcctctgaatccatcagggtcttaaatatttaaagaaaggctaaattcagaaggtatttaagaaatgggcaggccctgctgggtcctgatgagtccagtgcctccgggagctgcccaatgggccagcagtctctgtggaatccaggtgacccttcccactagggattggaccaacacttcacgcagctttcttccgaggaccccaacgaaggagtgatttgaacccaagtcaaaagggtgccctacaaggctagtttgaacagaacccctaccctgatgtgactcccagagaacaactgaccagagaaattggcactccagaatttagaatacagatgtggtttcgaaaccagagaacacaacacctcagacagagtctactggggtctggattggggtcgatttcctggaattgctatcagggaagaactggctgcacaaacaggcctctcagagtccagaactcagatatggtttcataaccaaagagctcggcactgtggccagagttgtagacttgtgaattccctggcagaaggccccaagtcggagacctcacatgactgtgtgacaaggcaaggcaacttgtgcatggcccctagcagtggggtcacttccctccctccagttctttcagcaacaaccagctcttcttccacctcacacatgctttggttcttgggttccccctgggctcggagtgagccaggcaccaagggtcatgatgctccacccaccaggctgtgctgggaggagagatctctccacctcttctgacacttaggagtcacatgtcgacaggcccagctctaggaggggcgctcttacatcctctggctcctttccagcccccacaccaaggaagatgccaggatgacaaggacagagacacatggcctggcagtactgccctgtaaggactctacacagccccaacctggcaatcctaagcaccagttgcagggaactggtcagcaagacacatctcaccttatgcagtggtggcacaaggggccccaaggagtgatgtcaaatggccagctggagcaggggcacttcagcagcccacagagcctgcacacacctggacatccctgtggcagtagcgggcaccaccagctgcagagccatctcagccactcgagcaaccgcacagctctctgcaaaacccatccttttaggtcaatgcctgtcaattgtatagtttcagaaaaagacacaagcctgcctgaatccaagtccacaggaaaaggtccctccaccacttgaaccacctctcagtgaggaagaatttgatgctctgcctgatgtgatgcagacctcaccagggtgtcagctttgggaggagcaaggcctccttctcacctccaccatctaggccactttcctggacacagaatcaatgtgataccaagaaggacaaacaatgcacacactgtgtttggcagcaagaccaatgcgagaaaaagcaccaaacacttagaaacccaaagggagcattttgactcagtcttgtgggaggcgcttgacttctcctctcacttaatggcctatatgattgttgcaaagctctctactgcccctgtaaggcatcatgggcaccaagccatgaatgccttcactgcatcctgaagaaccaaagcatttttatagcaaacatcacctactccctgcaatcctcaccgcttgggcagtctggactatacaggaactggaaccaaaccaaaccagggcgaggacactaggtctaagggggacagctccacacttctttccttctggcaagttcagaagtcacacctgaaagcaggtagatgtctagaatatagagggatgctgtattttcttgttctgtgagttgataacaaggagtttttaatctcagctctgagagttgcaaatgggaattggaagtcacttcactacccacctcttgggaactgattccacaagtttatatccataatcccgagtaggcttcatgaccagttttccctctgaacattgaaatgtagagaaaatgacagaagttagaatagcaactcccttagatcattgaacaaagcatatgaatgttactcttctcacattgttagcatttctgtatgttaacctgtacttctacccatcaagctgccctttttattataaataaatgtcaagtttaaataaatctga

SEQ ID NO: 291093 - DNA, 1330 bp, Homo sapiens
tggcctgggcactgcctgggggaagtatgctgcctggatgctcagacccacctgggcaggtcatttctggctactgtaatgactttcagagacagggaagcagaggcctctaacgccagggctttctgttgggtgggcagccagcacagggacaggcagatgatggcacactccccgatgatcctgtccccacacctgcgaaagcccaccacacttcagcagtgtaagtggtcatccaccagctgtggaataccaaccttctgcaggcccaagagctgcagcacctcaagtccctcctggaagggaggcagaggccccaggcagccccaaggctgacagcatcctgacaggacagcgagcccagattcatggagaaggggacacagtgatgaacaactgacaaacacaggaataataaatttattataatcacagatggtggggtagtgcacataaaaaggggggacctcttctcaccagagggtgctggccggtgcccagagtggcaggcaacatagggaggcgctccctgcatggcccggcccgctgccaggcccgctgtctctgggtgctcagtgtgtggtgctctgaggacacgggtcctgagggccttgctcttcatccttcacagtggggacacggccctcatgccagcggcacaggggtgccggcagcaggatccctgacgcccctgctccctgggtgccccacggtgctcagcaggaatgccgtgagggctgaggcccagctggtggcggggagccagcagcacctatgggccagccctccctccaaaaggcagcctgtgccctggacttgcaggcttcctcggggggtgctccacctgcccaaagcagcatagcctgaacccaaaactgtgaccagagaatcccatgtgtgttttaagggtttcctatgtcctctgtgttctataggaacgagtaggggtgcgtctagcacacacgagacgctctaacaacaccctgagtgcaccctcacgctgctgagatggacctggaccgtggacaggccacggtgagagcagcctgaggatcgcatctggctcctgggaggaagtcacatggagggccttctctaagaagtcggccaacgccccccaagcaacccgctccactgcgcctatcccagttctgtacaggtgtgggatttcgtttggcaggtccccaaggcagaagataaaagcaggaaagctaacctaaccccaggctctctaaggaagccaacacctagaagtgtctgacaggaggcgtgtgtccttggccccgatgaggctgcaggccatccctgcagtcttggctaggcggccgca

SEQ ID NO: 291094 - DNA, 494 bp, Homo sapiens
gtatgctgcctggatgctcagacccacctgggcaggtcatttctggctactgtaatgactttcagagacagggaagcagaggcctctaacgccagggctttctgttgggtgggcagccagcacagggacaggcagatgatggcacactccccgatgatcctgtccccacacctgcgaaagcccaccacacttcagcagtgtaagtggtcatccaccagctgtggaataccaaccttctgcaggcccaagaggtgaggccctgggtggtggggatggccctgggcagcctggtgccaccgcaggccccaccacacccctgcccctgcctttcagctgcagcacctcaagtccctcctggaagggaggcagaggccccaggcagccccaaggctgacagcatcctgacaggacagcgagcccagattcatggagaaggggacacagtgatgaacaactgacaaacacaggaataataaatttattataatcacaga

SEQ ID NO: 291095 - DNA, 462 bp, Homo sapiens
cggccgagagagcggagcacgaggaggcgggggcggcagagaagtgatgctggcgccggggatcggggcagcggcagcggagcagcagcatcttcgggaccctggctgcagcgtccctgtggcccgcgcgccagcccagcggccggagaccacgcgccccgcggacccattagaaacgcttcaagagctgctcagtccaggagtggagggattttgtgaagacacagatgctccctaaaaggagtgcagaaattttcatcatagggagaatgaagacagtgtgtgacaacctgaaaaagacaagtctttggttatcagaaaaactacctttaaagctaattttgaaaacagatcatttagataaaataacatggagaagatgaaaagaaaaatcaagtttacaacagattcagagaaccttgaagttgattatgattttaagaataacagaggagccaagat

SEQ ID NO: 291096 - DNA, 992 bp, Homo sapiens
ggggtaaattccaagcacagcctgaatgagaagtacaactcatttcctgtaacctagatgcctttttaacacatctatgcagtctccatgtgaaaccaggtgctgttcccaaaggagaaaacactgccctccagtggtcttcaatgaagaaatggaaatagtttcaggtggaaaccaggcttcttggaagacttcaaactatgccaaatggtctgatttcaccatagagattctttgctgaagaatgcagctgtattaaaggaagaaagaaaaccaagctacagctccttataattcaacaagcatttaaaagatttataaagatggtgcaattatgtatttaagctgcttcaacacaagttcttgcctttcactcccaccctgtggcttacactggtattacatctattctgacatttaaaaatcaacattaaagaacatattgtaataatgtattctatggtttaaatatttaaaaaattttacatcatacctagaaagtgttgtgtactttctaaagcttataaactgaaaaggatttgaagaatcctaatacagaatcataagttataattcatccaaaattgtatagttcttaaatttcaaatccaaaccagtggatatctgtctttagtgacatttagattttattcaattaaggtcattgtagctattataaatggaagattttacttcattgtgtcttatcactgaagtacttcactcttgcttttcaaaagatttctttcaatttcttcagagtcttatttgttctctaagacaaagacttgatttcagtttgtttttcttaaaattaatatcttctccaatttatttcccagttttttctaaataaatactttaaatatatagagtattatttttatagtatctcagaattagtaaaataaaatcttgccaatacaaacaatttgtgattttatacattatattgtcagactgaagtaaaataaagattattttgttgctgc

SEQ ID NO: 291097 - DNA, 1077 bp, Homo sapiens
ggggtaaattccaagcacagcctgaatgagaagtacaactcatttcctgtaacctagatgcctttttaacacatctatgcagtctccatgtgaaaccaggtgctgttcccaaaggagaaaacactgccctccagtggtcttcaatgaagaaatggaaatagtttcaggtggaaaccaggcttcttggaagacttcaaactatgccaaatggtctgatttcaccatagagaaatctaagctgagacaacttaaaactcaaatgagatgcatgaaagcacttgtcatcctgacaccatattgagaaacatgatcagattctttgctgaagaatgcagctgtattaaaggaagaaagaaaaccaagctacagctccttataattcaacaagcatttaaaagatttataaagatggtgcaattatgtatttaagctgcttcaacacaagttcttgcctttcactcccaccctgtggcttacactggtattacatctattctgacatttaaaaatcaacattaaagaacatattgtaataatgtattctatggtttaaatatttaaaaaattttacatcatacctagaaagtgttgtgtactttctaaagcttataaactgaaaaggatttgaagaatcctaatacagaatcataagttataattcatccaaaattgtatagttcttaaatttcaaatccaaaccagtggatatctgtctttagtgacatttagattttattcaattaaggtcattgtagctattataaatggaagattttacttcattgtgtcttatcactgaagtacttcactcttgcttttcaaaagatttctttcaatttcttcagagtcttatttgttctctaagacaaagacttgatttcagtttgtttttcttaaaattaatatcttctccaatttatttcccagttttttctaaataaatactttaaatatatagagtattatttttatagtatctcagaattagtaaaataaaatcttgccaatacaaacaatttgtgattttatacattatattgtcagactgaagtaaaataaagattattttgttgctgc

SEQ ID NO: 291098 - DNA, 598 bp, Homo sapiens
ggggtaaattccaagcacagcctgaatgagaagtacaactcatttcctgtaacctagatgcctttttaacacatctatgcagtctccatgtgaaaccaggtgctgttcccaaaggagaaaacactgccctccagtggtcttcaatgaagaaatggaaatagtttcaggtggaaaccaggcttcttggaagacttcaaactatgccaaatggtctgatttcaccatagagaatgttatactattaattgccaatttgcatatgtgtgcagctgctgttttggctctgaactcaatccgataagcttgctggaggtatcgcagagcacttggcagctttcctatttgaaaagaaagcctctcccctctacagaacagctgatcgtctatcagcgatagaccctgatggcgtgaattacaattacactacttttcacactaaatctgggtgatagctacttggaaagaagtttcatcattttttaccacaaactggaaaaagaattacatggtcatgctgtgcttttaaaggcagtttggttcacttttgtctatttaacacctaattccaagaagtccataggcatctagagatctgaat

SEQ ID NO: 291099 - DNA, 3195 bp, Homo sapiens
cggcgctcctaggagcaggcgttcccgactccggcaagagggtggcgcctggactctcgccctcagagggaggcccgtcccacggtctgtggctacggatcccaggaccctcttcgcgggcgattcgcgtagcctcagattgcctcggatgatggcctgcgactgacagtctctcagctcttctcagctctcctgaggctgcagctgtcagctccctgatcctcagcacttgcctggaccagtgcgggtctgccacgccctgttcagccatccctgtcctgttgtgtcgtgcaagccacatctgtccacacccccaccacccaccagtgctggctctcctctcttctcccctgtgctcccagcatgcctcgtggccggtgccgtcagcagggccctcgcattcccatctgggcagccgccaattatgccaacgcacatccatggcagcagatggacaaggcgtctcctggggtggcatacaccccccttgtggatccctggattgagcggccctgctgtggggacaccgtgtgtgtgcgaacgaccatggagcagaagagcacagctagtggcacttgtggcggtaaacctgcagaaaggggtcccctagctgggcacatgcccagctcccgaccccacagggtggacttctgctgggtaccaggctcagacccaggcacctttgatggctccccgtggctactggaccgcttcttggcccagctgggcgattacatgtccttccactttgagcactatcaggacaacatcagccgtgtctgcgagatcctcaggcgcctaacaggccgagcccaggcctgggcagccccctaccttgatggggacctgcccctgcctgacgattacgagctcttctgccaggatctcaaggaagttgttcaagacccgaacagttttgctgagtaccatgctgtggttacctgtcccctgcccctggcctccagccagctgccagtggcccctcagctgcctgtggtgaggcaatacttagctaggttcttagagggcctggcactcgacatgggtactgcccccaggtctttaccagccgccatggccacccctgctgtgtctgggtccaactctgtatctagaagtgctctgttcgagcagcagctgaccaaggagagcacccctgggcccaaggagcccccagtcctgcccagttctacatgtagctccaagcctggtcctgtggaaccagcctcttcccagccagaggaggcagcccccacacctgtccctagactgtcggagtcagctaatcctcctgcccagagaccagacccagctcatccaggaggtccaaaaccccagaaaacagaggaggaggttttggagacagagggagaccaggaggtgtccttaggtaccccacaggaggtggtggaggccccggagaccccaggagagccaccactttctcctgggttctgaacacagcccaggtgggaacaatgctgcccctcatgatgaagtggcctgtgtggcttgagcgccccatagtccccagtcagagcagagtggtgtccccagatgacttcagaccccatagctgggcaagatgcgcttgttttggactctgcgctgagcagaaccagctcccccaactccagcagagcttgacctccgccctgtgccctttccctgctgctggctctctgctgcatccctgcccgtcttctgggagtgccgtctcacccaggcctgctcccacgagggggtcgttttgtagatcaactctcagcagatagttgcatcatctttgtcacctccacccccatcgtctgccctgttgggacctcgttcctgtatggggtttctgtgtctgtccccctagccccaccctctctgctccctgtgacttctgtcccagctggaatgtgaggaaggctgcctggaggaagtggccactttgattctgggggatgagtgggatagcatcttggcaaagaatgatgtttcctgtgggattaccagcagttctgggcagctggaaggtttggatgcaggaaggtgggatgcaagccccttgccaggctcagctgcaggcattcgccctttgtgtgttaacactgtagctctaatcgtgcctggtgttctgaagcaggctcctcttccctgctgctgtgctgccatcccctgctcactccgcactcgcatgcattgcggattcagcacttaagccctagtgtgtaaatgacttggatctccctcctggcagactgtgaccctcagcacaggggctctgtcttagtcagctctgtggcctggtacacaattggtgctcattaaacacgtgttggattactggctgaggtggtgcagtggctgcctaccagcaagtctttgtttcccattctgtcaggagcagaggcctggccatgagcattccaggtcagcattgcagctgtggtttctggcaggggctttgagggtccaagggtctgatcaaagaagctgggtggggctgagtagggggtgggtggctctgcaggtagagaactgacttccgagagctgtaggtgaagtgaggaccaggcagcagtccagagctgtgaggccccaggcccagaggaatggaatgaagaaagacctgttccacacaaggaggggttttctagtggaagctgagcttggaagctcctggagccaagtttaccacaggataggcaggtacagccgcccagtgtgtgcagtgtgtgcccactctggtgcttggacaagaagttcaagtccctttcaggtttacaattgtgaaaacaacaaaacaacaccttcctggaaagtaggaagaaaaagcagaaatgtgaattggaaatacagccaactattttaggaaaaactaattagcaagcatctgattaaacttattcagaaactggccgggagcagtgtctcacacctgtaatcccagcactctgggaggccaaggtgggtggatcacctgaggtcaggagttcaagaccagcctgaccagcatggagaaatccatctctcctaaaaatacaaaattagccaagtgtggtggtgcatgcctgtaatctcagctacttgggaggctgaggcagaagaattgcttgaacccaggaggcagagggtgtggtgagccgagatcacgccattgcactccagcctggacaacaagagtgaaactccatcccaaaaaaaaaa

SEQ ID NO: 291100 - DNA, 1380 bp, Homo sapiens
ccaggtcagcattgcagctgtggtttctggcaggggctttgagggtccaagggctctctgctccctgtgacttctgtcccagctggaatgtgaggaaggctgcctggaggaagtggccactttgattctgggggatgagtgggatagcatcttggcaaagaatgatgtttcctgtgggattaccagcagttctgggcagctggaaggtttggatgcaggaaggtgggatgcaagccccttgccaggctcagctgcaggcattcgccctttgtgtgttaacactgtagctctaatcgtgcctggtgttctgaagcaggctcctcttccctgctgctgtgctgccatcccctgctcactccgcactcgcatgcattgcggattcagcacttaagccctagtgtgtaaatgacttggatctccctcctggcagactgtgaccctcagcacaggggctctgtcttagtcagctctgtggcctggtacacaattggtgctcattaaacacgtgttggattactggctgaggtggtgcagtggctgcctaccagcaagtctttgtttcccattctgtcaggagcagaggcctggccatgagcattccaggtcagcattgcagctgtggtttctggcaggggctttgagggtccaagggtctgatcaaagaagctgggtggggctgagtagggggtgggtggctctgcaggtagagaactgacttccgagagctgtaggtgaagtgaggaccaggcagcagtccagagctgtgaggccccaggcccagaggaatggaatgaagaaagacctgttccacacaaggaggggttttctagtggaagctgagcttggaagctcctggagccaagtttaccacaggataggcaggtacagccgcccagtgtgtgcagtgtgtgcccactctggtgcttggacaagaagttcaagtccctttcaggtttacaattgtgaaaacaacaaaacaacaccttcctggaaagtaggaagaaaaagcagaaatgtgaattggaaatacagccaactattttaggaaaaactaattagcaagcatctgattaaacttattcagaaactggccgggagcagtgtctcacacctgtaatcccagcactctgggaggccaaggtgggtggatcacctgaggtcaggagttcaagaccagcctgaccagcatggagaaatccatctctcctaaaaatacaaaattagccaagtgtggtggtgcatgcctgtaatctcagctacttgggaggctgaggcagaagaattgcttgaacccaggaggcagagggtgtggtgagccgagatcacgccattgcactccagcctggacaacaagagtgaaactccatcccaaaaaaaaaa

SEQ ID NO: 291101 - DNA, 2390 bp, Homo sapiens
cggcgctcctaggagcaggcgttcccgactccggcaagagggtggcgcctggactctcgccctcagagggaggcccgtcccacggtctgtggctacggatcccaggaccctcttcgcgggcgattcgcgtagcctcagattgcctcggatgatggcctgcgactgacagtctctcagctcttctcagctctcctgaggctgcagctgtcagctccctgatcctcagcacttgcctggaccagtgcgggtctgccacgccctgttcagccatccctgtcctgttgtgtcgtgcaagccacatctgtccacacccccaccacccaccagtgctggctctcctctcttctcccctgtgctcccagcatgcctcgtggccggtgccgtcagcagggccctcgcattcccatctgggcagccgccaattatgccaacgcacatccatggcagcagatggacaaggcgtctcctggggtggcatacaccccccttgtggatccctggattgagcggccctgctgtggggacaccgtgtgtgtgcgaacgaccatggagcagaagagcacagctagtggcacttgtggcggtaaacctgcagaaaggggtcccctagctgggcacatgcccagctcccgaccccacagggtggacttctgctgggtaccaggctcagacccaggcacctttgatggctccccgtggctactggaccgcttcttggcccagctgggcgattacatgtccttccactttgagcactatcaggacaacatcagccgtgtctgcgagatcctcaggcgcctaacaggccgagcccaggcctgggcagccccctaccttgatggggacctgcccctgcctgacgattacgagctcttctgccaggatctcaaggaagttgttcaagacccgaacagttttgctgagtaccatgctgtggttacctgtcccctgcccctggcctccagccagctgccagtggcccctcagctgcctgtggtgaggcaatacttagctaggttcttagagggcctggcactcgacatgggtactgcccccaggtctttaccagccgccatggccacccctgctgtgtctgggtccaactctgtatctagaagtgctctgttcgagcagcagctgaccaaggagagcacccctgggcccaaggagcccccagtcctgcccagttctacatgtagctccaagcctggtcctgtggaaccagcctcttcccagccagaggaggcagcccccacacctgtccctagactgtcggagtcagctaatcctcctgcccagagaccagacccagctcatccaggaggtccaaaaccccagaaaacagaggaggaggttttggagacagagggagaccaggaggtgtccttaggtaccccacaggaggtggtggaggccccggagaccccaggagagccaccactttctcctgggttctgaacacagcccaggtgggaacaatgctgcccctcatgatgaagtggcctgtgtggcttgagcgccccatagtccccagtcagagcagagtggtgtccccagatgacttcagaccccatagctgggcaagatgcgcttgttttggactctgcgctgagcagaaccagctcccccaactccagcagagcttgacctccgccctgtgccctttccctgctgctggctctctgctgcatccctgcccgtcttctgggagtgccgtctcacccaggcctgctcccacgagggggtcgttttgtagatcaactctcagcagatagttgcatcatctttgtcacctccacccccatcaaacaccccccttggtgtcttccacactggctgggactgaactgggtctgccacgtctgccctgttgggacctcgttcctgtatggggtttctgtgtctgtccccctagccccaccctctctgctccctgtgacttctgtcccagctggaatgtgaggaaggctgcctggaggaagtggccactttgattctgggggatgagtgggatagcatcttggcaaagaatgatgtttcctgtgggattaccagcagttctgggcagctggaaggtttggatgcaggaaggtgggatgcaagccccttgccaggctcagctgcaggcattcgccctttgtgtgttaacactgtagctctaatcgtgcctggtgttctgaagcaggctcctcttccctgctgctgtgctgccatcccctgctcactccgcactcgcatgcattgcggattcagcacttaagccctagtgtgtaaatgacttggatctccctcctggcagactgtgaccctcagcacaggggctctgtcttagtcagctctgtggcctggtacacaattggtgctcattaaacacgtgttggattactggc

SEQ ID NO: 291102 - DNA, 418 bp, Homo sapiens
tccctctcagacatttattggttcattcattcgttcattttgctgtaactcacagtggccctccccatcctaaggtgcactgctgggattggtctatgtgctgatgatgttctccttgtcttcagaggaaaaagaatgcctgtgtttcgaagttccttcttaggacgaaaccagctgaagctggcgaaatccaagatggcgcctctgaagagcctctggctttatcatcatcctgttctcatgctaaacaacatgtcgccatgacaacgactggaagagaccaagaagggacagaaaaaaaggggtttcttgattccgggaaaaatctccgttctttcccaaggaaagcacgaatattcccccccgtgctcttaatgcccagccccttcattaaagacaccctacctctgaaacttcc

SEQ ID NO: 291103 - DNA, 2578 bp, Homo sapiens
actcactatagggctcgagcggccgcctgggcaggtgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctata

SEQ ID NO: 291104 - DNA, 2808 bp, Homo sapiens
ccgggtcctgggcgagcgggcgccgtgcgcgtgtcccgcggccgagctgctaataaagttgcagcgaggagaagcgcagcgacggcgtcgggagagcgcgcctagccggctcgcgaaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctata

SEQ ID NO: 291105 - DNA, 3300 bp, Homo sapiens
tgataggactgcggtgctcggccgggcagcctgggctgctgcactgcgaagctgttccaatggcttgatgaatccgtgccgccgtcgctttgtgtttcaaagataaggatccgcgcttatcggtgggaattacactctgggcagttgtgaccggctactgcaatcagctggtagttagacctggtttctgccacttgccatgtcagttttcaccactgcaaggatttcttctacttcatgtaaacttctctgtgctgcaaagagaatgccaaagcagcgtctttttgccttcaccatattcagccgctggccgggtcctatacttcaatatcagggctcaaattaatattccagtctcttcccctccccttttcccctctcctcctttcagctgctgttactacgtggagtttggagcctaagctttgaaaactcccatgtggcgcgcccgtcttaagtctgagcatgctcagtagccaaaacagatttttggttgcagaactcgggcgaggatacttggggtatttggacgtttgccggcttcccaacagaatgttccggttctggtggtgatggcattggagaatggggcttaggcaagcctgtagaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctata

SEQ ID NO: 291106 - DNA, 2892 bp, Homo sapiens
ccgggtcctgggcgagcgggcgccgtgcgcgtgtcccgcggccgagctgctaataaagttgcagcgaggagaagcgcagcgacggcgtcgggagagcgcgcctagccggctcgcgaaaaggaagctgttgaagttattgaagtacctgttgctatattctaagaaattaaaatgtccagaaatctgcctctaaatgggatctcactatgttgctcagactggacgtgattgaactcctgggctcaagtgagtctcccgaataactgggattacaggacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctata

SEQ ID NO: 291107 - DNA, 2814 bp, Homo sapiens
tgataggactgcggtgctcggccgggcagcctgggctgctgcactgcgaagctgttccaatggcttgatgaatccgtgccgccgtcgctttgtgtttcaaagataaggatccgcgcttatcgaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctata

SEQ ID NO: 291108 - DNA, 2733 bp, Homo sapiens
ccgggtcctgggcgagcgggcgccgtgcgcgtgtcccgcggccgagctgctaataaagttgcagcgaggagaagcgcagcgacggcgtcgggagagcgcgcctagccggctcgcgagacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctata

SEQ ID NO: 291109 - DNA, 1896 bp, Homo sapiens
ctgtcgccttaatccaagcctacgttttcacacttctagtaagcctctacctggaggtctacctgggttaggtctacctgcccaggtagacctaacctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctata

SEQ ID NO: 291110 - DNA, 1975 bp, Homo sapiens
ccgggtcctgggcgagcgggcgccgtgcgcgtgtcccgcggccgagctgctaataaagttgcagcgaggagaagcgcagcgacggcgtcgggagagcgcgcctagccggctcgcgaaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagtctctgcaggagatatagtaataactgaagtgttacacaggtggagacgggaaacgttagttgctaagaactttggattaccaccgctaggaaaccagccacttggaagaccaatcaataaaggagtgttcaactcaatatttcacctgatacaagatgatgaaacgggctatcagaaatacagaaataacgatgaaggcatggagtggatgatcaagctcaggtcattggctccagaactcagactcttggtcaccactatgctacctctccttgactcctagcatctgcagctacctccccaccgtgatctccagcctctcccccaacccccaccaacaaaaatgcgttaacctcaacc

SEQ ID NO: 291111 - DNA, 1493 bp, Homo sapiens
ccgggtcctgggcgagcgggcgccgtgcgcgtgtcccgcggccgagctgctaataaagttgcagcgaggagaagcgcagcgacggcgtcgggagagcgcgcctagccggctcgcgaaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttgggtgttgggcgataacatcgatgttatccccaacacataactatttcactttctcaaaaaaagactttcacttttttcttgaacaaaaaacattcttggtcttttgttttcctaattttgatactttggagtacaaataatttcacttacttcttaacttaaaaaaggtggcacaggatgggcgcggtggctcatgcctgtaatcccagcactttgggaggccgaggtgggcagatcacgaggtcaggagatcaagaccacggtgaaaccccgtctctactaa

SEQ ID NO: 291112 - DNA, 1535 bp, Homo sapiens
ccgggtcctgggcgagcgggcgccgtgcgcgtgtcccgcggccgagctgctaataaagttgcagcgaggagaagcgcagcgacggcgtcgggagagcgcgcctagccggctcgcgaaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtaatcttgtcattttcctacatttaatcgaattcaatcatttgttgtacttgccatgaaccatgcattgtgaaaggtgctagaaacatacaaagaagtttgacacgtggcctctgccttaagttgccgatattgaagaatgtattaatcaaataaagacatgatgttccctcatttt

SEQ ID NO: 291113 - DNA, 459 bp, Homo sapiens
gagcgctcacctctgtttaactcctattgtgttaaattctctgttttatggttgttttttaatatcctttatctcatagaacaggagtggtatctttctctggattttctgtcttccagggtaccttatgcaggctaaatgcttacagagttttggattcagtttttatgtaaatagagattcagggctctataaaacagccctttctaaaagtaaattgttttaataggtttacagtcttacatgaatcctttctaccaaccccttagtgtggatggggcatttgtttagtcattcctgacaaatgacttttgatttttgtttttcagtcttacctccagtattagtgcctcgtcataatgaattcaatccacaacacagccttctggttcagtttaggaacctgagccacaatgaaccacacatgccacaaaatgccacgtttccagattctttcca

SEQ ID NO: 291114 - DNA, 3309 bp, Homo sapiens
aggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaagaaagaaaaagaaaaaaagataagaagaaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtggtggtaaatgctatattatgaacggtggcatgtatttacagttagagtattgtgtgtacactttttaatggtaaacttaagctgaatgtgtaatggatttgtgtatagttttacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttagaggtgaaggtactgtttctaaaaacacatcactgtgatacctttctatcctcacattttcaagcttgcctcttttctgttctttgtggatataacttaagcaattgtgttattcataaaggtttagaaatttcagtattcccaacactctatgtttctgattttataacagtagccatttttgaaagtcagatgtttggcctgttttatatgaataaagtttatttataaaatattataaaaaataagtaaataaacagaacattaataataaagttttggttcttcctat

SEQ ID NO: 291115 - DNA, 2239 bp, Homo sapiens
  misc_feature (64)..(64): n is a, c, g, or t
tctctatatattccttccttaaaattcatgattttgggccaaaaaaaaaaagcatatcgaaacnaaattttaactactaatgggaaggttcaaaagctgccacgtatttctagtacaatgtatccaataagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaagaaagaaaaagaaaaaaagataagaagaaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtggtggtaaatgctatattatgaacggtggcatgtatttacagttagagtattgtgtgtacactttttaatggtaaacttaagctgaatgtgtaatggatttgtgtatagttttacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttagaggtgaaggtactgtttctaaaaacacatcactgtgatacctttctatcctcacattttcaagcttgcctcttttctgttctttgtggatataacttaagcaattgtgttattcataaaggtttagaaatttcagtattcccaacactctatgtttctgattttataacagtagccatttttgaaagtcagatgtttggcctgttttatatgaataaagtttatttataaaatattataaaaaataagtaaataaacagaacattaataataaagttttggttcttcctat

SEQ ID NO: 291116 - DNA, 3047 bp, Homo sapiens
aggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaagaaagaaaaagaaaaaaagataagaagaaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtggtggtaaatgctatattatgaacggtggcatgtatttacagttagagtattgtgtgtacactttttaatggtaaacttaagctgaatgtgtaatggatttgtgtatagttttacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttagaggtgaaggtactgtttctaaaaacacatcactgtgatacctttctatcctcacattttcaagcttgcctcttttctgttctttgtggatataacttaagcaattgtgttattcataaaggtttagaaatttcagtattcccaacactctatgtttctgattttataacagtagccatttttgaaagtcagatgtttggcctgttttatatgaataaagtttatttataaaatattataaaaaataagtaaataaacagaacattaataataaagttttggttcttcctat

SEQ ID NO: 291117 - DNA, 1193 bp, Homo sapiens
aggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttggtaagttatttttatttgtgttaacgggttactgagtaagagaatgattagtcatagtactgtagtagcagcacttgtataaaataaagcttaattttttagaataacaattttaaacacttgaagtacttctatgttggatagcatcaaatataaaactagcttttggttttggataggaaaagtaagaagtgatcaacttctttgtgaaattcataagagtttgaaaataagtgaacgagtattatggtatggaggaagaaccctaagctaggagttaggagatctagggtttttgccttgtcctcagaatttgccctgagaattatgtagaaccatgtttctatgatgaataatttaagcatttagaatggagatgaagaaatatggaagaaggaatattgaattcaagtaaggccattaggcatcacatagtatttaagcttcttggcatcactgtttttcatcattaaagtgaggagatgagacattcactgatatcttatagccttcggaacagtaacagggggacggaaacgcttggtacgggcagacaccgagctccctcccaaccggggaaggcacagcccctacccccaagggacgacaacagcccccaactcccagcggggcccccccacgctggccccc

SEQ ID NO: 291118 - DNA, 1549 bp, Homo sapiens
aggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaagttcaagtacccttacaagactgatggaattacagttgtataaatatggactactgaagaatctgaagtattgtattatttgactttattttaggcctctagtaaagacttaaatgttttttaaaaaaagcacaaggcacagagattagagcagctgtaagaacacatctactttatgcaatggcattagacatgtaagtcagatgtcatgtcaaaattagtacgagccaaattctttgttaaaaaaccctatgtatagtgacactgatagttaaaagatgttttattatattttcaataactaccactaacaaatttttaacttttcatatgcatattctgatatgtggtcttttaggaaaagtatggttaatagttgatttttcaaaggaaattttaaaattct

SEQ ID NO: 291119 - DNA, 1531 bp, Homo sapiens
aggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccccccgcatggagtgtctcgctatgttgccccgcggtgtggggggagttctctaactcccggcctcaagcaatcctcctgcctctacctcccaaagtattgggataagctaatatttttaaagagaaaggaaggaggcaatatgaggcctctaaagaagagaggtaggaagaaggtgaagcccagatgcctggagcgcacagagctgcagccactgcctgcagctttgcttatgagggggattgagtttcttcaggccatgatgtttgatttgcgtttggagcagtaagccttacagctgataaatggttttttttctcctgggggagcacgagactctaggaagataatctattaggagaacctgagtgagccactt

SEQ ID NO: 291120 - DNA, 2009 bp, Homo sapiens
ctatcactggtgaatgactgagctgggattcaaagaactctcccagaaccaggagcttttcacccatggggagaatgataggaaataaaactgaagctagcaagggaacttggaaaaatacctccacagagctagatgtgcactgagactaggacccaggtcttccatcccacaagctggaggggtatctgagcatttccctaaggaaacagcaggaagtatgatgcctactcaactttagaaagtctcgcctgactgagagcccgtcctcaaagtcagaacagactcaaactataaattcactcttctcacctgccttccttcccaatacatagccaggatgggcagcactaataaaatgaggaatcataggccccaccccagttctgaaccagacctgaactcaaaaacaatcttcagataactcatatccaaactaaggcttgagaaacgcctctaaagaacagaaggaaggattgttactggaaggagtaagaaaccccccaactgcttctaccaattttgttgacattcttgtttttaaaaaactaatagcagggcactcttacaaggtgacttaatgttgacaacctcccaagacttaatctacaacatgtaacctctcaatactatctacaatatggagtagacacctatttcaatcatctacatatctacaggaatccaaagtcaatgacttgtatcaaaatggtattcaagactaacttttccattatctaacctgacttactctttttcaaaacctagcccgagatgctccagatactgactggtgtgactccatcccagcacgggacagactgccatgtgcaccttcacccatctctcgaggagactgtgaagggctaggctgttgttatagctctgaagaggtgaattcctgctactatggaaacactgtgaccttgcattgtacccgagagggccatttctctattgctgtgtctcggaacgtgacctcgccaccactgctcttggattctgtgcgcttggcccttaggaatgacagtgcgtgtaaccctgtgatggcaacacaagcttttgttctgttccagtttccatttacttcctgtggcaccacaagacagatcactggagaccgagcagtatatgaaaatgaactggtggcaactagggatgtgaaaaatgggagccgtggctctgtcactcgtgacagcatcttcaggctccatgtcagctgcagctactcagtaagtagcaactctctcccaatcaatgtccaggttttcactctcccaccaccctttcctgagacccagcctggacccctcactctggaacttcagattgccaaagataaaaactatggctcttactacggtgttggtgactacccagtggtgaagttgcttcgggatcccatttacgtggaggtctccatccttcacagaacagacccctacctggggctgctcctacaacagtgttgggcaacacccagcactgaccccctgagtcagccacagtggcccatcctggtaaagggctgcccctacattggagacaactatcagacccagctgatccctgtccagaaagccttggatcttccatttccctctcaccaccagcgcttcagcatcttcaccttcagctttgtgaaccctacagtggagaaacaggccctcaggggaccggtgcatctgcactgcagcgtgtcagtctgccagcctgctgagacaccatcctgtgtggtgacctgtcctgatctcagtcgaagaagaaattttgacaacagttctcagaacactactgctagtgtttctagcaaaggccccatgattctactccaagccactaaggaccctccagaaaagctccgtgttcctgtagactcgaaagttctgtgggtggcaggcctttctgggaccttaatccttggagccttgttagtatcctacttggctgtcaagaaacagaagagttgcccagaccaaatgtgtcaataaaaccagagtgtattccca

SEQ ID NO: 291121 - DNA, 1641 bp, Homo sapiens
atgtggctgctgcggtgcgttttgctgtgtgtttcattatctcttgctgtgagtggccagcataagcctgaggcaccagattattccagtgtgctccactgtgggccgtggagcttccagtttgctgtaaacctcaaccaggaggcaacgtctcctcctgtactaatagcttgggacaaccaagggctgctgcacgagctgcagaatgactccgactgtggcacctggataagaaaaggtccaggcagctccgtggtgttggaggcaacctatagcagctgctatgtcactgagtgggactcccactacatcatgccagttggagttgaaggagcaggcgcggctgaacacaaggtggttacagagaggaagctgctcaagtgtcctatggatcttctagcccgagatgctccagatactgactggtgtgactccatcccagcacgggacagactgccatgtgcaccttcacccatctctcgaggagactgtgaagggctaggctgttgttatagctctgaagaggtgaattcctgctactatggaaacactgtgaccttgcattgtacccgagagggccatttctctattgctgtgtctcggaacgtgacctcgccaccactgctcttggattctgtgcgcttggcccttaggaatgacagtgcgtgtaaccctgtgatggcaacacaagcttttgttctgttccagtttccatttacttcctgtggcaccacaagacagatcactggagaccgagcagtatatgaaaatgaactggtggcaactagggatgtgaaaaatgggagccgtggctctgtcactcgtgacagcatcttcaggctccatgtcagctgcagctactcagtaagtagcaactctctcccaatcaatgtccaggttttcactctcccaccaccctttcctgagacccagcctggacccctcactctggaacttcagattgccaaagataaaaactatggctcttactacggtgttggtgactacccagtggtgaagttgcttcgggatcccatttacgtggaggtctccatccttcacagaacagacccctacctggggctgctcctacaacagtgttgggcaacacccagcactgaccccctgagtcagccacagtggcccatcctggtaaagggctgcccctacattggagacaactatcagacccagctgatccctgtccagaaagccttggatcttccatttccctctcaccaccagcgcttcagcatcttcaccttcagctttgtgaaccctacagtggagaaacaggccctcaggggaccggtgcatctgcactgcagcgtgtcagtctgccagcctgctgagacaccatcctgtgtggtgacctgtcctgatctcagtcgaagaagaaattttgacaacagttctcagaacactactgctagtgtttctagcaaaggccccatgattctactccaagccactaaggaccctccagaaaagctccgtgttcctgtagactcgaaagttctgtgggtggcaggcctttctgggaccttaatccttggagccttgttagtatcctacttggctgtcaagaaacagaagagttgcccagaccaaatgtgtcaataaaaccagagtgtattccca

SEQ ID NO: 291122 - DNA, 959 bp, Homo sapiens
ctatgtgaggaggcagctgcaaggcaccacccctgagggatgggccctcaccaaacactgagcctaccatgccttaatcttggacttcccagcctccatgaacgccatacaagacgttaacaaaagaggaagctgggtaaagtgtattcatgaattctgcactattttgcaactcttagaaatttggactgggctgtgtgcttctcctataccattctccagctacttctggatgaagaggaagggaatggaggtcttgaaaggtggaagagtcatgctgaaatgttagctgcatatcagacccagaaaatacagcaagttttttggctgggcgcagcggctcaggaggagggcgcccgggaaatacctgctgcgtgaatgaataaatgaatgaaatgcttgggccctgggaaatgcttgggcccgcggccgcctgaccacgcgggctggaggatcggacgtaccgccggtgccccaccaggagacgaaggcatggttgggatgcgcagccctcccacgaggcccatggcgccccagggccctagggattgaccgggacccccgactggcagagtccacctgcttgatacacttatttgagaagggaggcctgggactatcttactccttttaggaaaacccaactgtagctgctattcctttggttcaggccgcaaggaagaattgtaggttaccatgaatccatgaacccctctttagtatacaaagtccactttcatgacggaagaattggaaagctccctccagagttgtcagtactcaattattagcatataaaaagtcaaattttcccagggattttcagactttagaacctgctagtgacctgtggcctcagctttcttccagccactctgagtattgtaaaacaaagatattatcccaaccctgaaggcagataccagattgtacgccatggtcttctgtttcaaagggat

SEQ ID NO: 291123 - DNA, 201 bp, Homo sapiens
gatctagaggatcccgacagcaccctaaccagcagaggctgcaagtcgggccatagttcagttcctagagattaatcagagtgaagaagccagtagaggctggatgcttctaacgacaattaatttgttagcttcctctggtcagaaaaccgtggactgcatgacaacaatgtcagtgccttccaccctggttaaatgttt

SEQ ID NO: 291124 - DNA, 842 bp, Homo sapiens
gcggccgcagaatcgagctcgggccccggcccccggcccgcggcgcggggctcccgggccccgccgcggacgtcgcgccggtcgccccttccccgtagcccgtgcgccctcggcgcggagccccggcccgccgcggtcccgtctcctgggcctgtcccgcccgcgccctccgccggccctcaggtataatacttctccacgtctgcttcaggaagaaagtgcctgccattcttatcatttctaagcaggttcatgccagcccagaacagagaatcagaattagaagtgcgtctcaccaaccagccaagatgaacatggtgaagaggatcatggggcggccgaggcaggaggagtgcagcccacaagacaacgccttaggactgatgcacctccgccggctcttcacggagttgtgccatcctccccggcacatgactcagaaggaacaagaagagaaactgtatatgatgctgccagtgtttaacagggtttttggaaatgctccgccgaatacaatgacagaaaaattttctgatcttctgcagttcacaacacaagtctcacgactaatggtgacagaaattcgaaggagagcatcaaacaaatccacaggtatttttacagtagccagcaaaaactgatttgtttgaatgaacaagcagttctgtaaaagtcccattaaaattaaatggaaaacagaccttgttctcagcacattgagttcatttacccattccctttccctttcttagagtcacattcttttcctggtttcagcatcttcaactctccagtagttctgctcaaggctactctgcctggaccactaccacttccaccct

SEQ ID NO: 291125 - DNA, 931 bp, Homo sapiens
gcggccgcagaatcgagctcgggccccggcccccggcccgcggcgcggggctcccgggccccgccgcggacgtcgcgccggtcgccccttccccgtagcccgtgcgccctcggcgcggagccccggcccgccgcggtcccgtctcctgggcctgtcccgcccgcgccctccgccggccctcaggtataatacttctccacgtctgcttcaggaagaaagtgcctgccattcttatcatttctaagcaggttcatgccagcccagaacagagaatcagatgtcttcaattgctgtggtgacaagaacatagtgaatataagctgctgaaagtagagctagtcgtggctggaacagagagaaattcagaattagaagtgcgtctcaccaaccagccaagatgaacatggtgaagaggatcatggggcggccgaggcaggaggagtgcagcccacaagacaacgccttaggactgatgcacctccgccggctcttcacggagttgtgccatcctccccggcacatgactcagaaggaacaagaagagaaactgtatatgatgctgccagtgtttaacagggtttttggaaatgctccgccgaatacaatgacagaaaaattttctgatcttctgcagttcacaacacaagtctcacgactaatggtgacagaaattcgaaggagagcatcaaacaaatccacaggtatttttacagtagccagcaaaaactgatttgtttgaatgaacaagcagttctgtaaaagtcccattaaaattaaatggaaaacagaccttgttctcagcacattgagttcatttacccattccctttccctttcttagagtcacattcttttcctggtttcagcatcttcaactctccagtagttctgctcaaggctactctgcctggaccactaccacttccaccct

SEQ ID NO: 291126 - DNA, 942 bp, Homo sapiens
gcggccgcagaatcgagctcgggccccggcccccggcccgcggcgcggggctcccgggccccgccgcggacgtcgcgccggtcgccccttccccgtagcccgtgcgccctcggcgcggagccccggcccgccgcggtcccgtctcctgggcctgtcccgcccgcgccctccgccggccctcaggtataatacttctccacgtctgcttcaggaagaaagtgcctgccattcttatcatttctaagcaggttcatgccagcccagaacagagaatcagctggagcccagatttcaagttttgagtaaaataccttcaagcgaatgggccctattgtgctcacacattcagaacctgttacccaaggaattccctaaagaattagaagtgcgtctcaccaaccagccaagatgaacatggtgaagaggatcatggggcggccgaggcaggaggagtgcagcccacaagacaacgccttaggactgatgcacctccgccggctcttcacggagttgtgccatcctccccggcacatgactcagaaggaacaagaagagaaactgtatatgatgctgccagtgtttaacagggtttttggaaatgctccgccgaatacaatgacagaaaaattttctgatcttctgcagttcacaacacaagtctcacgactaatggtgacagaaattcgaaggagagcatcaaacaaatccacaggtatttttacagtagccagcaaaaactgatttgtttgaatgaacaagcagttctgtaaaagtcccattaaaattaaatggaaaacagaccttgttctcagcacattgagttcatttacccattccctttccctttcttagagtcacattcttttcctggtttcagcatcttcaactctccagtagttctgctcaaggctactctgcctggaccactaccacttccaccct

SEQ ID NO: 291127 - DNA, 778 bp, Homo sapiens
gcggccgcagaatcgagctcgggccccggcccccggcccgcggcgcggggctcccgggccccgccgcggacgtcgcgccggtcgccccttccccgtagcccgtgcgccctcggcgcggagccccggcccgccgcggtcccgtctcctgggcctgtcccgcccgcgccctccgccggccctcaggtataatacttctccacgtctgcttcaggaagaaagtgcctgccattcttatcatttctaagcaggttcatgccagcccagaacagagaatcagaattagaagtgcgtctcaccaaccagccaagatgaacatggtgaagaggatcatggggcggccgaggcaggaggagtgcagcccacaagacaacgccttaggactgatgcacctccgccggctcttcacggagttgtgccatcctccccggcacatgactcagaaggaacaagaagagaaactgtatatgatgctgccagtgtttaacagggtttttggaaatgctccgccgaatacaatgacagaaaaattttctgatcttctgcagttcacaacacaagtctcacgactaatggtgacagaaattcgaaggagagcatcaaacaaatccacagaggctgcaagtcgggccatagttcagttcctagagattaatcagagtgaagaagccagtagaggctggatgcttctaacgacaattaatttgttagcttcctctggtcagaaaaccgtggactgcatgacaacaatgtcagtgccttccaccctggttaaatgttt

SEQ ID NO: 291128 - DNA, 848 bp, Homo sapiens
gcggccgcagaatcgagctcgggccccggcccccggcccgcggcgcggggctcccgggccccgccgcggacgtcgcgccggtcgccccttccccgtagcccgtgcgccctcggcgcggagccccggcccgccgcggtcccgtctcctgggcctgtcccgcccgcgccctccgccggccctcagctggagcccagatttcaagttttgagtaaaataccttcaagcgaatgggccctattgtgctcacacattcagaacctgttacccaaggaattccctaaagaattagaagtgcgtctcaccaaccagccaagatgaacatggtgaagaggatcatggggcggccgaggcaggaggagtgcagcccacaagacaacgccttaggactgatgcacctccgccggctcttcacggagttgtgccatcctccccggcacatgactcagaaggaacaagaagagaaactgtatatgatgctgccagtgtttaacagggtttttggaaatgctccgccgaatacaatgacagaaaaattttctgatcttctgcagttcacaacacaagtctcacgactaatggtgacagaaattcgaaggagagcatcaaacaaatccacaggtatttttacagtagccagcaaaaactgatttgtttgaatgaacaagcagttctgtaaaagtcccattaaaattaaatggaaaacagaccttgttctcagcacattgagttcatttacccattccctttccctttcttagagtcacattcttttcctggtttcagcatcttcaactctccagtagttctgctcaaggctactctgcctggaccactaccacttccaccct

SEQ ID NO: 291129 - DNA, 2522 bp, Homo sapiens
tatgacgacatggtcgtaaatccgccatcttcctgcggcgcgttgcgacatggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccaccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagagccccccgtctcccaggagctcccctgctccagcgagggcagccgtgagaacctgctgcaccaggccatgcagaactccggcatcgtccttgagcgcgctgctggggaggagggtgccctggagccagctcctgctgccgggtccagtccccagcccctggcagtggcagccccgcagctgccggtactggaagtgcagccgctggagacacaggtggccagcgaggcctcagcggtgcccaggacccacccatgtcctcagtgcagtgagaccttcccgacagcagccaccctggaggcccacaagaggggccacaccgggccgaggccgttcgcctgcgcgcagtgtggcaaggccttccccaaggcctacctgctcaagaagcaccaggaggtgcacgtgcgtgagcgccgcttccgctgtggcgactgcgggaagctctacaagaccattgcccatgtgcgtggccaccggcgcgtccactcagacgagcggccctacccttgtcccaagtgtggcaagcgctacaagactaagaacgcacagcaggtgcacttcaggacacacctggaggagaagccgcacgtgtgccagttctgcagccgtggcttccgagagaagggctcactggtgcggcacgtgcgacaccacacaggcgagaagccgttcaagtgctacaagtgcggccgtggcttcgccgagcacggcacgctgaaccggcacctgcgcaccaaagggggctgcctgctggaggtggaggagttgctggtgtctgaggacagccccgcggcagccaccaccgtcctcacggaagacccgcacacagtgccactgcggacgatgcggagaccagtgaggccacggagatcatcgagggcacccagacagaggtggacagccacatcatgaaggtggtgcagcagatcgtgcaccaggctagcgccggccaccagatcatcgtgcagaacgtcaccatggacgaggagacggcgctgggcccagaggcggctgccgccgacaccatcaccattgccacccccgagagcctgacagagcaggtggccatgacgctggcctcggccatcagcgagggcactgtgcttgccgcccgggcagggacaagtggcactgaacaggccactgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgca

SEQ ID NO: 291130 - DNA, 2676 bp, Homo sapiens
tatgacgacatggtcgtaaatccgccatcttcctgcggcgcgttgcgacatggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccaccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagagccccccgtctcccaggagctcccctgctccagcgagggcagccgtgagaacctgctgcaccaggccatgcagaactccggcatcgtccttgagcgcgctgctggggaggagggtgccctggagccagctcctgctgccgggtccagtccccagcccctggcagtggcagccccgcagctgccggtactggaagtgcagccgctggagacacaggtggccagcgaggcctcagcggtgcccaggacccacccatgtcctcagtgcagtgagaccttcccgacagcagccaccctggaggcccacaagaggggccacaccgggccgaggccgttcgcctgcgcgcagtgtggcaaggccttccccaaggcctacctgctcaagaagcaccaggaggtgcacgtgcgtgagcgccgcttccgctgtggcgactgcgggaagctctacaagaccattgcccatgtgcgtggccaccggcgcgtccactcagacgagcggccctacccttgtcccaagtgtggcaagcgctacaagactaagaacgcacagcaggtgcacttcaggacacacctggaggagaagccgcacgtgtgccagttctgcagccgtggcttccgagagaagggctcactggtgcggcacgtgcgacaccacacaggcgagaagccgttcaagtgctacaagtgcggccgtggcttcgccgagcacggcacgctgaaccggcacctgcgcaccaaagggggctgcctgctggaggtggaggagttgctggtgtctgaggacagccccgcggcagccaccaccgtcctcacggaagacccgcacacagtgttggtggagttctcgtccgtggtagctgacacccaggagtatatcatcgaggccactgcggacgatgcggagaccagtgaggccacggagatcatcgagggcacccagacagaggtggacagccacatcatgaaggtggtgcagcagatcgtgcaccaggctagcgccggccaccagatcatcgtgcagaacgtcaccatggacgaggagacggcgctgggcccagaggcggctgccgccgacaccatcaccattgccacccccgagagcctgacagagcaggtggccatgacgctggcctcggccatcagcgagggcactgtgcttgccgcccgggcagggacaagtggcactgaacaggccactgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgcaaaaaaaaacgaaagaacgaaaaaaatctcgcggaacatagtccgggggagccggaccccatttggggccgtggggcacgggacttgagagcaacaggtcccg

SEQ ID NO: 291131 - DNA, 2827 bp, Homo sapiens
tatgacgacatggtcgtaaatccgccatcttcctgcggcgcgttgcgacatggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccaccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagagccccccgtctcccaggagctcccctgctccagcgagggcagccgtgagaacctgctgcaccaggccatgcagaactccggcatcgtccttgagcgcgctgctggggaggagggtgccctggagccagctcctgctgccgggtccagtccccagcccctggcagtggcagccccgcagctgccggtactggaagtgcagccgctggagacacaggtggccagcgaggcctcagcggtgcccaggacccacccatgtcctcagtgcagtgagaccttcccgacagcagccaccctggaggcccacaagaggggccacaccgggccgaggccgttcgcctgcgcgcagtgtggcaaggccttccccaaggcctacctgctcaagaagcaccaggaggtgcacgtgcgtgagcgccgcttccgctgtggcgactgcgggaagctctacaagaccattgcccatgtgcgtggccaccggcgcgtccactcagacgagcggccctacccttgtcccaagtgtggcaagcgctacaagactaagaacgcacagcaggtgcacttcaggacacacctggaggagaagccgcacgtgtgccagttctgcagccgtggcttccgagagaagggctcactggtgcggcacgtgcgacaccacacaggcgagaagccgttcaagtgctacaagtgcggccgtggcttcgccgagcacggcacgctgaaccggcacctgcgcaccaaagggggctgcctgctggaggtggaggagttgctggtgtctgaggacagccccgcggcagccaccaccgtcctcacggaagacccgcacacagtgttggtggagttctcgtccgtggtagctgacacccaggagtatatcatcgaggtgggtgtggggccctggggccgtgctgggacccaggggcagccaaggctgacctctgtccttctgcccatctgcccaggccactgcggacgatgcggagaccagtgaggccacggagatcatcgagggcacccagacagaggtgaggggtagggcaggcgggggcggggaggctccctggcacagccgctcttgctgagccgtggccctgcaggtggacagccacatcatgaaggtggtgcagcagatcgtgcaccaggctagcgccggccaccagatcatcgtgcagaacgtcaccatggacgaggagacggcgctgggcccagaggcggctgccgccgacaccatcaccattgccacccccgagagcctgacagagcaggtggccatgacgctggcctcggccatcagcgagggcactgtgcttgccgcccgggcagggacaagtggcactgaacaggccactgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgcaaaaaaaaacgaaagaacgaaaaaaatctcgcggaacatagtccgggggagccggaccccatttggggccgtggggcacgggacttgagagcaacaggtcccg

SEQ ID NO: 291132 - DNA, 2861 bp, Homo sapiens
gtcttgaactcctgggctcaagctatcctcccaccttggccccttaaagtgctgagattacaagtgtgagccaccatgcccggccccagcagtcttaaatcctggtcctttactgtccccaaattagcatggaggagtccctctgcctcccagcccctctctgggcctctcgcctgtcagtcgctgaggtgggttttgagcatggcagccttagcaggtccctgcagcctaagcgtgctgtcagggccaccctctgctgggtgctgacctcctgagggtgggtctggcccctgcagacctgcagaggataggggctgtaccttgggatgaccttgttttgggcccgagtgtgttctcagcagcctggggaagtagctctgcttctgatggcctcctgggggaatctgttctagggctggaggaaaagccagacggagccctggctgcccagcctccgccttcccaggccctgctgacagcaggctcgttgcagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccaccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagagccccccgtctcccaggagctcccctgctccagcgagggcagccgtgagaacctgctgcaccaggccatgcagaactccggcatcgtccttgagcgcgctgctggggaggagggtgccctggagccagctcctgctgccgggtccagtccccagcccctggcagtggcagccccgcagctgccggtactggaagtgcagccgctggagacacaggtggccagcgaggcctcagcggtgcccaggacccacccatgtcctcagtgcagtgagaccttcccgacagcagccaccctggaggcccacaagaggggccacaccgggccgaggccgttcgcctgcgcgcagtgtggcaaggccttccccaaggcctacctgctcaagaagcaccaggaggtgcacgtgcgtgagcgccgcttccgctgtggcgactgcgggaagctctacaagaccattgcccatgtgcgtggccaccggcgcgtccactcagacgagcggccctacccttgtcccaagtgtggcaagcgctacaagactaagaacgcacagcaggtgcacttcaggacacacctggaggagaagccgcacgtgtgccagttctgcagccgtggcttccgagagaagggctcactggtgcggcacgtgcgacaccacacaggcgagaagccgttcaagtgctacaagtgcggccgtggcttcgccgagcacggcacgctgaaccggcacctgcgcaccaaagggggctgcctgctggaggtggaggagttgctggtgtctgaggacagccccgcggcagccaccaccgtcctcacggaagacccgcacacagtgttggtggagttctcgtccgtggtagctgacacccaggagtatatcatcgaggccactgcggacgatgcggagaccagtgaggccacggagatcatcgagggcacccagacagaggtggacagccacatcatgaaggtggtgcagcagatcgtgcaccaggctagcgccggccaccagatcatcgtgcagaacgtcaccatggacgaggagacggcgctgggcccagaggcggctgccgccgacaccatcaccattgccacccccgagagcctgacagagcaggtggccatgacgctggcctcggccatcagcgagggcactgtgcttgccgcccgggcagggacaagtggcactgaacaggccactgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgca

SEQ ID NO: 291133 - DNA, 2838 bp, Homo sapiens
tatgacgacatggtcgtaaatccgccatcttcctgcggcgcgttgcgacatggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccaccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagagccccccgtctcccaggagctcccctgctccagcgagggcagccgtgagaacctgctgcaccaggccatgcagaactccggcatcgtccttgagcgcgctgctggggaggagggtgccctggagccagctcctgctgccgggtccagtccccagcccctggcagtggcagccccgcagctgccggtactggaagtgcagccgctggagacacaggtggccagcgaggcctcagcggtgcccaggacccacccatgtcctcagtgcagtgagaccttcccgacagcagccaccctggaggcccacaagaggggccacaccgggccgaggccgttcgcctgcgcgcagtgtggcaaggccttccccaaggcctacctgctcaagaagcaccaggaggtgcacgtgcgtgagcgccgcttccgctgtggcgactgcgggaagctctacaagaccattgcccatgtgcgtggccaccggcgcgtccactcagacgagcggccctacccttgtcccaagtgtggcaagcgctacaagactaagaacgcacagcaggtgcacttcaggacacacctggaggagaagccgcacgtgtgccagttctgcagccgtggcttccgagagaagggctcactggtgcggcacgtgcgacaccacacaggcgagaagccgttcaagtgctacaagtgcggccgtggcttcgccgagcacggcacgctgaaccggcacctgcgcaccaaagggggctgcctgctggaggtggaggagttgctggtgtctgaggacagccccgcggcagccaccaccgtcctcacggaagacccgcacacagtgttggtggagttctcgtccgtggtagctgacacccaggagtatatcatcgaggccactgcggacgatgcggagaccagtgaggccacggagatcatcgagggcacccagacagaggtggacagccacatcatgaaggtggtgcagcagatcgtgcaccaggctagcgccggccaccagatcatcgtgcagaacgtcaccatggacgaggagacggcgctgggcccagaggcggctgccgccgacaccatcaccattgccacccccgagagcctgacagagcaggtggccatgacgctggcctcggccatcagcgagggcactgtgcttgccgcccgggcagggacaagtggcactgaacaggccactgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgcaaaaaaaaaaaaaaaaaaaaaaaattggggggattaatgcgcggggtggcgggaaaaagcgagggcaatggacatggggcccatggggccaaatgcggggtgttccccggtgggccccaggagttctctcgtggcaccaaagggggggcggtagaacctcgggcgcggagtctcccccatatatatggcgagaggcgcggcatataaagttcgcgagaaaagacgcacagggttaaaccccggcgccttaaagagcccggggaaa

SEQ ID NO: 291134 - DNA, 1455 bp, Homo sapiens
tatgacgacatggtcgtaaatccgccatcttcctgcggcgcgttgcgacatggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccaccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagagcaggtggccagcgaggcctcagcggtgcccaggacccacccatgtcctcagtgcagtgagaccttcccgacagcagccaccctggaggcccacaagaggggccacaccgggccgaggccgttcgcctgcgcgcagtgtggcaaggccttccccaaggcctacctgctcaagaagcaccaggaggtgcacgtgcgtgagcgccgcttccgctgtggcgactgcgggaagctctacaagaccattgcccatgtgcgtggccaccggcgcgtccactcagacgagcggccctacccttgtcccaagtgtggcaagcgctacaagactaagacgcacctctggccgcaggaccc

SEQ ID NO: 291135 - DNA, 1108 bp, Homo sapiens
tatgacgacatggtcgtaaatccgccatcttcctgcggcgcgttgcgacatggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaaggtaaccgggccgacccggagggtgcggccggggtgcgggcagttcatcccgggctggcagaggcccggatggcccgagctgcgggctcgaccgaccctcccagacccagacacctcgcggatctcgcgggaccctcacagccctccacgaaacccccagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccaccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaaggggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgca

SEQ ID NO: 291136 - DNA, 1253 bp, Homo sapiens
gtcttgaactcctgggctcaagctatcctcccaccttggccccttaaagtgctgagattacaagtgtgagccaccatgcccggccccagcagtcttaaatcctggtcctttactgtccccaaattagcatggaggagtccctctgcctcccagcccctctctgggcctctcgcctgtcagtcgctgaggtgggttttgagcatggcagccttagcaggtccctgcagcctaagcgtgctgtcagggccaccctctgctgggtgctgacctcctgagggtgggtctggcccctgcagacctgcagaggataggggctgtaccttgggatgaccttgttttgggcccgagtgtgttctcagcagcctggggaagtagctctgcttctgatggcctcctgggggaatctgttctagggctggaggaaaagccagacggagccctggctgcccagcctccgccttcccaggccctgctgacagcaggctcgttgcagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtaagccgacttccatgaatcgctggcctgatagaccttcgtggttggggccagaggatggggcccctgctgcctgtatgctcgtctctcccgagaccagggcctggctgggaggggccgcggcctcgtggcagcctttctgcgggcacagcctgcaggaggaggaagcgttgggcactgggccttcctcaggtgtccacagtggccgggggcacacccaggcaccagggagtcattgggctgtgctctctcccgtcagctttcccgggtggtctctgccgtgtccctcccagaatcttccccacttccctgccaccccctggttcctgctccctgcccgtaggcagcaacatccaccaggcacccaccagaatggcccactcgcccagcagcggctctggagggtgggtacagggtggacgggactctcccgcctctctagctgggctcggacttgctgctggccgtggcctgccctccccagtgctccctctggtgtggg

SEQ ID NO: 291137 - DNA, 2574 bp, Homo sapiens
tatgacgacatggtcgtaaatccgccatcttcctgcggcgcgttgcgacatggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccaccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagagccccccgtctcccaggagctcccctgctccagcgagggcagccgtgagaacctgctgcaccaggccatgcagaactccggcatcgtccttgagcgcgctgctggggaggagggtgccctggagccagctcctgctgccgggtccagtccccagcccctggcagtggcagccccgcagctgccggtactggaagtgcagccgctggagacacaggtggccagcgaggcctcagcggtgcccaggacccacccatgtcctcagtgcagtgagaccttcccgacagcagccaccctggaggcccacaagaggggccacaccgggccgaggccgttcgcctgcgcgcagtgtggcaaggccttccccaaggcctacctgctcaagaagcaccaggaggtgcacgtgcgtgagcgccgcttccgctgtggcgactgcgggaagctctacaagaccattgcccatgtgcgtggccaccggcgcgtccactcagacgagcggccctacccttgtcccaagtgtggcaagcgctacaagactaagaacgcacagcaggtgcacttcaggacacacctggaggagaagccgcacgtgtgccagttctgcagccgtggcttccgagagaagggctcactggtgcggcacgtgcgacaccacacaggcgagaagccgttcaagtgctacaagtgcggccgtggcttcgccgagcacggcacgctgaaccggcacctgcgcaccaaagggggctgcctgctggaggtggaggagttgctggtgtctgaggacagccccgcggcagccaccaccgtcctcacggaagacccgcacacagtgttggtggagttctcgtccgtggtagctgacacccaggagtatatcatcgaggccactgcggacgatgcggagaccagtgaggccacggagatcatcgagggcacccagacagaggtggacagccacatcatgaaggtggtgcagcagatcgtgcaccaggctagcgccggccaccagatcatcgtgcagaacgtcaccatggacgaggagacggcgctgggcccagaggcggctgccgccgacaccatcaccattgccacccccgagagcctgacagagcaggtggccatgacgctggcctcggccatcagcgagggcactgtgcttgccgcccgggcagggacaagtggcactgaacaggccactgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgca

SEQ ID NO: 291138 - DNA, 2733 bp, Homo sapiens
tatgacgacatggtcgtaaatccgccatcttcctgcggcgcgttgcgacatggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaaggtaaccgggccgacccggagggtgcggccggggtgcgggcagttcatcccgggctggcagaggcccggatggcccgagctgcgggctcgaccgaccctcccagacccagacacctcgcggatctcgcgggaccctcacagccctccacgaaacccccagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccaccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagagccccccgtctcccaggagctcccctgctccagcgagggcagccgtgagaacctgctgcaccaggccatgcagaactccggcatcgtccttgagcgcgctgctggggaggagggtgccctggagccagctcctgctgccgggtccagtccccagcccctggcagtggcagccccgcagctgccggtactggaagtgcagccgctggagacacaggtggccagcgaggcctcagcggtgcccaggacccacccatgtcctcagtgcagtgagaccttcccgacagcagccaccctggaggcccacaagaggggccacaccgggccgaggccgttcgcctgcgcgcagtgtggcaaggccttccccaaggcctacctgctcaagaagcaccaggaggtgcacgtgcgtgagcgccgcttccgctgtggcgactgcgggaagctctacaagaccattgcccatgtgcgtggccaccggcgcgtccactcagacgagcggccctacccttgtcccaagtgtggcaagcgctacaagactaagaacgcacagcaggtgcacttcaggacacacctggaggagaagccgcacgtgtgccagttctgcagccgtggcttccgagagaagggctcactggtgcggcacgtgcgacaccacacaggcgagaagccgttcaagtgctacaagtgcggccgtggcttcgccgagcacggcacgctgaaccggcacctgcgcaccaaagggggctgcctgctggaggtggaggagttgctggtgtctgaggacagccccgcggcagccaccaccgtcctcacggaagacccgcacacagtgttggtggagttctcgtccgtggtagctgacacccaggagtatatcatcgaggccactgcggacgatgcggagaccagtgaggccacggagatcatcgagggcacccagacagaggtggacagccacatcatgaaggtggtgcagcagatcgtgcaccaggctagcgccggccaccagatcatcgtgcagaacgtcaccatggacgaggagacggcgctgggcccagaggcggctgccgccgacaccatcaccattgccacccccgagagcctgacagagcaggtggccatgacgctggcctcggccatcagcgagggcactgtgcttgccgcccgggcagggacaagtggcactgaacaggccactgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgca

SEQ ID NO: 291139 - DNA, 2828 bp, Homo sapiens
tatgacgacatggtcgtaaatccgccatcttcctgcggcgcgttgcgacatggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccaccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagaggtgggggcgacggggggccccggagggctgctctgtcttctgcctgctcggtgccagtctttgttctgggcactggctccaggggtctgagccaggcaggcgagggctgggcttcccacagggagagcagggccagtgggagcgccatgggggtctgagggtttgcacaaggctcctggcgtgcgtctgccccatggggtgggtgctggatgccaggctgcctggccagcctcctctctctgcctcccctgcagccccccgtctcccaggagctcccctgctccagcgagggcagccgtgagaacctgctgcaccaggccatgcagaactccggcatcgtccttgagcgcgctgctggggaggagggtgccctggagccagctcctgctgccgggtccagtccccagcccctggcagtggcagccccgcagctgccggtactggaagtgcagccgctggagacacaggtggccagcgaggcctcagcggtgcccaggacccacccatgtcctcagtgcagtgagaccttcccgacagcagccaccctggaggcccacaagaggggccacaccgggccgaggccgttcgcctgcgcgcagtgtggcaaggccttccccaaggcctacctgctcaagaagcaccaggaggtgcacgtgcgtgagcgccgcttccgctgtggcgactgcgggaagctctacaagaccattgcccatgtgcgtggccaccggcgcgtccactcagacgagcggccctacccttgtcccaagtgtggcaagcgctacaagactaagaacgcacagcaggtgcacttcaggacacacctggaggagaagccgcacgtgtgccagttctgcagccgtggcttccgagagaagggctcactggtgcggcacgtgcgacaccacacaggcgagaagccgttcaagtgctacaagtgcggccgtggcttcgccgagcacggcacgctgaaccggcacctgcgcaccaaagggggctgcctgctggaggtggaggagttgctggtgtctgaggacagccccgcggcagccaccaccgtcctcacggaagacccgcacacagtgttggtggagttctcgtccgtggtagctgacacccaggagtatatcatcgaggccactgcggacgatgcggagaccagtgaggccacggagatcatcgagggcacccagacagaggtggacagccacatcatgaaggtggtgcagcagatcgtgcaccaggctagcgccggccaccagatcatcgtgcagaacgtcaccatggacgaggagacggcgctgggcccagaggcggctgccgccgacaccatcaccattgccacccccgagagcctgacagagcaggtggccatgacgctggcctcggccatcagcgagggcactgtgcttgccgcccgggcagggacaagtggcactgaacaggccactgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgca

SEQ ID NO: 291140 - DNA, 1294 bp, Homo sapiens
tatgacgacatggtcgtaaatccgccatcttcctgcggcgcgttgcgacatggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccaccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggttctggagctggagctgccggcttggggacagccacatcatcggtgacaggcgagcctatagagacttcacccgtgattcacctgtgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgca

SEQ ID NO: 291141 - DNA, 450 bp, Homo sapiens
tgttggttgcatggaggagtgtcatatacgcactcattccaccaaattcccttgatatcctttaccattactttataaaccatttacatttctcttgcagagagccacaacctaagtgccttacctgatgacactgacagagagaatcactggaaatgatagttttatacttaattcttgtcactaaaactctaatagtgtttttaaaaacctaatacaaggccaggcctggcggctcacacctatcatcccagcactttgggatgcctagggaggagaattgctcaaggccagaagtttgaaaccagaacagcctgggcaacatagtgagaccctgtctctgaaaaaacaaaacaaacaacaacagcaacaacaacaacaaaaatacctaacacaaatacttaaatgcatacaactatttttataacttttaacttttacacttagttg

SEQ ID NO: 291142 - DNA, 529 bp, Homo sapiens
aaggtcttgcattcatctctcccaggacagtgaagcctgctcagtctagacttacatgagagactactcaatgactctcacagaaaagagatcttcccaaggtgacatcttctcctcctaagccaataaggtcatcttactcacagtccacttccaggaactgaccccaaatggacagaatctacttatatcatggcacagctgtcaacttctcttgctaaagaagagaataacgctcacaaaattgccccagatggcggtgcaacatttttgggccaagtactacaactgaaaagcatgaacagagttttaccagcgggttacagctcttgtttaacttctagaaaactagtgacatgctcttggagaagcccctcttacagaaggccaaagaagctgagaaagcacagaggaaataatcaaggctcacctgggaaagcaacacagcttcaccatcattctctcgtccctgagaaaataaatcaaaacaaacaagtatattgagcactgggtgttcaaaaccacatga

SEQ ID NO: 291143 - DNA, 525 bp, Homo sapiens
gtgggaaccggacagcagccttggggacgcagcatcaacgacaccaaaggctgacagtgaactgaggacaatagtgacaagctcaccaagaaagaaggcaggatctcatgagaatgcgtaacaggacactccacctggcacggtaggtcaggaagaggtcctcaaagaaggaacacgtaaagtgtgagccagcggggcaggagtggaagctgcaagtgcatctttctgtatcgcgtttgtgagagctcattatcgagttgacacgaacccctggcccagcacatgctgcacatgccgtacctttcttgtgaagaatgttccgggctcgtaccaggtcaggatcgtcaggcccaacacccagaattctgagagacacatagttgagcgcagtcccaaacacggtggacttatcctcaatgtgcctacaggagcagaggacaggtgagaaaccggtatctgtccttacttctaagaaataaagcaaaactttctgtggagtttcctcagaaaactaagaatgctaaa

SEQ ID NO: 291144 - DNA, 2127 bp, Homo sapiens
caaatgggaggggacgtgttcccacctggtcgtctccccgtcctgtagccaaaccagacagaagcagcacctatgccaagcctcagcaaggtgggagaacccgcagcccccctccccttctgcaaaccagaacccagctgcagacaaagctggatgctgcgtggaccccggcctgctggagctggagtcgggccatctgaaggccgtgtggcctggatccagctgtgctgctctctctgagtgcccaccctctctggtcccagcaggcagctttgcaccacagaggcaggaagcaagctagacacagccggccctgcttcctgcccctgtgcagcctctggagaggggaggtgagagcagagccgccgggatctccctagtttctggccgcctcctccctgacagtcatcgccagattgtttatctgctaacagaacccagatttgtcccccaggacctccagtccctctgcaggccaggacctcgctcctccccaaccttccttagcatttccccacccaaaccccagacgaacatacaggaaggagagacagggagctgcctccaaacgcggccgtgcacccgcccaccccctcctgaaggccacatctgtgtcactgacacatatcgggggctttctgggtttctttagccgggcggccctgagcagcctggcccatccagcctctctgagctccatctgggtaacatccgtcatgcagggcgacatctcctccagcatgagcgctggagggctctggaggcccggcccccgctgccactacatggcttacagccctgcaaacaagcagggtggtcatgcactgaggttctcaatgggcgatcctgcccccagcggacccttggccatgtctgaacacacttgtggctgtcacgacggtgggtgccactggcacctagtgggcggcagccagggaggcggccacacacctgtgtcacacaggagggccctcacagcagagaggatctcctccaaacgtcagtagtgctgaggttgggagaccctgtaacagagccgcccgcactatggcgaggattacatgggaaagtgtgctgtgatgttctcggaacagtgtctggcacacaggaagccctcggcaaacaggggctgctgtgtttaccatcctcatctcagcctcgagaagtcaaagcagatgccaagatgcctgttttccaacaaggaaacaaagcccagaagagggacgtgctggcccagaactagaatctgggccccgatcctggtctctgagggagcctcctgcctggggccaggtcccatggagtgctggctccggacactaccaccatctcagaagggacgggctctggcccccaggatagaggctttctagagttggtgggggacatgtggggtgctgtttggggactggctgtgctcccaccccagcagcccctcctcccacgcccacaatggcagctgggaggctgccacacggagctctccggagccagctactgctcagcagagctcggccctcccgtttccaggaggtcacttggcctcgggagggctgccccgcgcctttcaggaggggatacaataggtggcgatgcaggcagtgaggccaaggccaccttccctgggactgagtccctggcatgcaccaggcaccgaggagggatggaagacgctgtgactttgatccacatgacctctccaagctcccaacagcctgtaggagggccgcctggtcccactgtccccccttcacagttggggaccgaggcccagggaggcaaaggaacctgcccgagagcccccagcccccagatcccccggcgcacccctcacaccatgctgccacccacgacccagaggacgtggccagctggaacctaccaggtgccctgcggctctcagtagcttgtgggtggagaacgggaaggcctcgttgctcaggtctgcgtccagcacctcctgcaaaatggctcggctgcaggcaagagcaaagtcgctcagtcagcaagtgctcacgggtggggcctgggcaggaaaggccccggggacctgccatgagtgggataagtccctgtcctcatgagacagatgacaataaacatggattaataaaaatacaccaagac

SEQ ID NO: 291145 - DNA, 813 bp, Homo sapiens
tggggccttctatcttcctaagagtgttctctgacagggctgttccctgcccagtgaaacaaaggaccaaagattttctcaaaaatgtttaaaaatttgacccatgtaacgcggacactccacactcacggaagtgggcagaagggggagggggaaaaaaaaggaaagaaaagcttcttcagcctcagcgcggagcagctgctcttccttacccagacgggacagtcgtggaccaccagcttgacattcccaaacgcactggcctgatactcggtgaacaccggacgcgcgaccgtgctggccgcgttcagcaacaagctgctctcgtccccggagaccagagggcttctccccaggttcagccatttaggaaagattggtgacctatctgcatgatggcattaactacaaggatcatcgaagagccacagtcacaaagccagtctctgaatatggttcaaagaaatcttataactctctgaacaggacgtgtattcgtcaacactacttggagggccggtacttccaaggaagtcacctttgcagtcgatctatgtgcactgttctcagagccagctcgcacccatgaagaacaacacaacttaccggtcataggagcagaaagtgtcaaccttgcagcaggatttggacactctgggagccaaactggatgtggaagctccaaaggtttacaaagtcctcttggagaagcagattcctgtgggaacctggttaaatctcccaagctagcagtgtttttactacaataagacagtgattaattgtgtcccactgggcactgtcctgataagg

SEQ ID NO: 291146 - DNA, 3661 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctaggtacgagctgaggggaagggttgctactgcagcaggaaggatggaggccagacagatcaggcctgggataccccgagggatctgggtgcccctgactggagagtagtagcacatcttccaccaacccatccccacctgcgcaagcttcctgaaaggtcaggaaggctgcactgatgcccaggcctcacccccagccctggtgacagtgcccagcatgggctatgctcctgttcctccccccacctcactgcagcccctgctgccccagcagcctgtgttcgtagtgcaagaggtgagtcctgcatgccctggggggcaggaactgtgctgggatactttcttacaactgagggtcctgagctcccctgtctggagcaagtggtgaggcggggctggggttggggtgggaagacttttggtgtgggaagcccctacagactcagcctcaaggcctcctcccacaaagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 291147 - DNA, 3378 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctagccctggtgacagtgcccagcatgggctatgctcctgttcctccccccacctcactgcagcccctgctgccccagcagcctgtgttcgtagtgcaagagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggtataggctgggcagcatgtggggatggtggaggtggtgggaacacaggctgctctggatcagtatgtccacccctgtcccataggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 291148 - DNA, 3552 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctagccctggtgacagtgcccagcatgggctatgctcctgttcctccccccacctcactgcagcccctgctgccccagcagcctgtgttcgtagtgcaagaggtgagtcctgcatgccctggggggcaggaactgtgctgggatactttcttacaactgagggtcctgagctcccctgtctggagcaagtggtgaggcggggctggggttggggtgggaagacttttggtgtgggaagcccctacagactcagcctcaaggcctcctcccacaaagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggtataggctgggcagcatgtggggatggtggaggtggtgggaacacaggctgctctggatcagtatgtccacccctgtcccataggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 291149 - DNA, 4155 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctaggtacgagctgaggggaagggttgctactgcagcaggaaggatggaggccagacagatcaggcctgggataccccgagggatctgggtgcccctgactggagagtagtagcacatcttccaccaacccatccccacctgcgcaagcttcctgaaaggtcaggaaggctgcactgatgcccaggcctcacccccagccctggtgacagtgcccagcatgggctatgctcctgttcctccccccacctcactgcagcccctgctgccccagcagcctgtgttcgtagtgcaagaggtgagtcctgcatgccctggggggcaggaactgtgctgggatactttcttacaactgagggtcctgagctcccctgtctggagcaagtggtgaggcggggctggggttggggtgggaagacttttggtgtgggaagcccctacagactcagcctcaaggcctcctcccacaaagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaaaaaaaaacacaacacaacacaaaaaaaaagggggcgcgccccgttttcaaatattatcccgcggggggccccagctttttacgcgccttcaccccgcgatttttcttggttacaaaggggccccctctttagggcaactccgttttataccgctaaggcccggggcaccggggtttttaaacacgcgtctgtaacctgggggaaacaactggcgtagccgtggacgcacaccttcgggtaaacgggcgcaccccctccctcctctgggggggtgggcaccaacattcttgcggcccaacacttacccttccggataattattccaacgcgcctccctaggggggtcacttattaacacttacacaggtgggttatactaacggcgtttaaccacatgcgctgcatattgccgtccccggcttggtacaagcttgcgccttaccgggacattgactttgcacaaactcttattcgccgggacgtgctctcaaagc

SEQ ID NO: 291150 - DNA, 3823 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctaggtacgagctgaggggaagggttgctactgcagcaggaaggatggaggccagacagatcaggcctgggataccccgagggatctgggtgcccctgactggagagtagtagcacatcttccaccaacccatccccacctgcgcaagcttcctgaaaggtcaggaaggctgcactgatgcccaggcctcacccccagccctggtgacagtgcccagcatgggctatgctcctgttcctccccccacctcactgcagcccctgctgccccagcagcctgtgttcgtagtgcaagaggtgagtcctgcatgccctggggggcaggaactgtgctgggatactttcttacaactgagggtcctgagctcccctgtctggagcaagtggtgaggcggggctggggttggggtgggaagacttttggtgtgggaagcccctacagactcagcctcaaggcctcctcccacaaagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaaccctgctgctcagtccccttagggcccatcctcacgcttggggtgggggtgggaagtctggggtgggatggcttcccaggtatttggtgggtaggggcaagatcctaaggtacctgtgcgtgcagggtctgggttgcagcccccacaggagagactggggac

SEQ ID NO: 291151 - DNA, 3590 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctaggtacgagctgaggggaagggttgctactgcagcaggaaggatggaggccagacagatcaggcctgggataccccgagggatctgggtgcccctgactggagagtagtagcacatcttccaccaacccatccccacctgcgcaagcttcctgaaaggtcaggaaggctgcactgatgcccaggcctcacccccagccctggtgacagtgcccagcatgggctatgctcctgttcctccccccacctcactgcagcccctgctgccccagcagcctgtgttcgtagtgcaagaggtgagtcctgcatgccctggggggcaggaactgtgctgggatactttcttacaactgagggtcctgagctcccctgtctggagcaagtggtgaggcggggctggggttggggtgggaagacttttggtgtgggaagcccctacagactcagcctcaaggcctcctcccacaaagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaaggcccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 291152 - DNA, 3742 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctaggtacgagctgaggggaagggttgctactgcagcaggaaggatggaggccagacagatcaggcctgggataccccgagggatctgggtgcccctgactggagagtagtagcacatcttccaccaacccatccccacctgcgcaagcttcctgaaaggtcaggaaggctgcactgatgcccaggcctcacccccagccctggtgacagtgcccagcatgggctatgctcctgttcctccccccacctcactgcagcccctgctgccccagcagcctgtgttcgtagtgcaagaggtgagtcctgcatgccctggggggcaggaactgtgctgggatactttcttacaactgagggtcctgagctcccctgtctggagcaagtggtgaggcggggctggggttggggtgggaagacttttggtgtgggaagcccctacagactcagcctcaaggcctcctcccacaaagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcaaggggtgggacgtgctggggacggggttccgaactgggcctgccctcggcccctcccaccagacgtgttcctctgcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 291153 - DNA, 3172 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctagccctggtgacagtgcccagcatgggctatgctcctgttcctccccccacctcactgcagcccctgctgccccagcagcctgtgttcgtagtgcaagagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtagtcggggggtagggggtggctgttttccccaagtgtgcttggtaaggaggggccagccccaggccttggtgtgtctcttccttccctgactcccaccctccttcccactcccaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtctgacatggcagggtgggagtggccttggactcctccctggctggggagactgcttgtgtggaacaggctggggaggaagaggataatcaacatttgctgcttcctaacgtgtgtgccaggcattgcactaaatgctttacattggcaaggcacagtggctcacgcctgtaattccagcactttgggaggccgaggtgggtggatcacctgaggtcaggagttcaagaccagcctggccaacatggtgaaacgccatctctactaaaaatacaaaaattgggccgggcgtggtgactcacgcctgtaatcccagcagtttgggaggctgaggtgggtggatcacgaggtcaagagatcgagaccatcctggctaacacgatgaaaccctgtctctactaaaaagctgaggcaggagaatggcgtgaatctgggaggcagagcttgcagtg

SEQ ID NO: 291154 - DNA, 2556 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctagccctggtgacagtgcccagcatgggctatgctcctgttcctccccccacctcactgcagcccctgctgccccagcagcctgtgttcgtagtgcaagagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctaatttctgcttccccagcctaaagcagggatcagtcttttcttgtggaataaatccttggatcgggaa

SEQ ID NO: 291155 - DNA, 1833 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatctcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcct

SEQ ID NO: 291156 - DNA, 199 bp, Homo sapiens
atcaagaaggggaaccgggaatgtgagcggatcctgcacgacgtggagctgctcagtagcctggccctggcccgcagtgcccagttcctatacccagcagcccagctgcagcacctctggaggtcagcccagttctgtccctgccatccacctgactgctcactgcagttacctctgtgcctgcccctcccagccttcc

SEQ ID NO: 291157 - DNA, 3293 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctagccctggtgacagtgcccagcatgggctatgctcctgttcctccccccacctcactgcagcccctgctgccccagcagcctgtgttcgtagtgcaagagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 291158 - DNA, 653 bp, Homo sapiens
ttgtgccgtattgcctgtgtaaattgtatccgcgaaacagaaggctcgaaccgcgagcagggcggcaaccgccagcagcgttaagccgcaggtcgtgggggcggctcgccaggtgcgggtccgccccttttcttttgccctgacggcgccctacatgacccgacgcttcgaagccgaagacctgctgctggaacagcgcatcaccgacatccatgtcatccccgaccaccccatcgcgctgtgtgccgtggcatgggcggacacccacagccgccgcaccgcatcgtcgctgtggaccttctcgctggcctacagcacatgccggcatgtgctgtaggcccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagacccgctggcctacagcacatgcctggcgatgtcgcgtgccatgtagagaatggaaggaagcatcgggcccatctcccaactgggctcagctggaaaccaggag

SEQ ID NO: 291159 - DNA, 3768 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctaggtacgagctgaggggaagggttgctactgcagcaggaaggatggaggccagacagatcaggcctgggataccccgagggatctgggtgcccctgactggagagtagtagcacatcttccaccaacccatccccacctgcgcaagcttcctgaaaggtcaggaaggctgcactgatgcccaggcctcacccccagccctggtgacagtgcccagcatgggctatgctcctgttcctccccccacctcactgcagcccctgctgccccagcagcctgtgttcgtagtgcaagaggtgagtcctgcatgccctggggggcaggaactgtgctgggatactttcttacaactgagggtcctgagctcccctgtctggagcaagtggtgaggcggggctggggttggggtgggaagacttttggtgtgggaagcccctacagactcagcctcaaggcctcctcccacaaagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctgtaagtggggtacccaccaggcctgggagctggcatggagaaatgggtcttcccgaccacaactccaacagcttcagcgtggcccctacgcgccctcctcaccccagcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 291160 - DNA, 3416 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctagccctggtgacagtgcccagcatgggctatgctcctgttcctccccccacctcactgcagcccctgctgccccagcagcctgtgttcgtagtgcaagagcccctacagactcagcctcaaggcctcctcccacaaagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggtataggctgggcagcatgtggggatggtggaggtggtgggaacacaggctgctctggatcagtatgtccacccctgtcccataggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 291161 - DNA, 4084 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctaggtacgagctgaggggaagggttgctactgcagcaggaaggatggaggccagacagatcaggcctgggataccccgagggatctgggtgcccctgactggagagtagtagcacatcttccaccaacccatccccacctgcgcaagcttcctgaaaggtcaggaaggctgcactgatgcccaggcctcacccccagccctggtgacagtgcccagcatgggctatgctcctgttcctccccccacctcactgcagcccctgctgccccagcagcctgtgttcgtagtgcaagaggtgagtcctgcatgccctggggggcaggaactgtgctgggatactttcttacaactgagggtcctgagctcccctgtctggagcaagtggtgaggcggggctggggttggggtgggaagacttttggtgtgggaagcccctacagactcagcctcaaggcctcctcccacaaagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaaggcccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaaaaaaaaacacaacacaacacaaaaaaaaagggggcgcgccccgttttcaaatattatcccgcggggggccccagctttttacgcgccttcaccccgcgatttttcttggttacaaaggggccccctctttagggcaactccgttttataccgctaaggcccggggcaccggggtttttaaacacgcgtctgtaacctgggggaaacaactggcgtagccgtggacgcacaccttcgggtaaacgggcgcaccccctccctcctctgggggggtgggcaccaacattcttgcggcccaacacttacccttccggataattattccaacgcgcctccctaggggggtcacttattaacacttacacaggtgggttatactaacggcgtttaaccacatgcgctgcatattgccgtccccggcttggtacaagcttgcgccttaccgggacattgactttgcacaaactcttattcgccgggacgtgctctcaaagc

SEQ ID NO: 291162 - DNA, 3620 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctaggtacgagctgaggggaagggttgctactgcagcaggaaggatggaggccagacagatcaggcctgggataccccgagggatctgggtgcccctgactggagagtagtagcacatcttccaccaacccatccccacctgcgcaagcttcctgaaaggtcaggaaggctgcactgatgcccaggcctcacccccagccctggtgacagtgcccagcatgggctatgctcctgttcctccccccacctcactgcagcccctgctgccccagcagcctgtgttcgtagtgcaagaggtgagtcctgcatgccctggggggcaggaactgtgctgggatactttcttacaactgagggtcctgagctcccctgtctggagcaagtggtgaggcggggctggggttggggtgggaagacttttggtgtgggaagcccctacagactcagcctcaaggcctcctcccacaaagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgccacactgagtccctggggctggggttttgtttgtagaaggctctggggactcctaatttctgcttccccagcctaaagcagggatcagtcttttcttgtggaataaatccttggatcgggaaaaaaaaagtaagaactatga

SEQ ID NO: 291163 - DNA, 3423 bp, Homo sapiens
ggtatcatactccagcaagcgcacatcatcagtgacgtcgatcacgatgcatcgtcatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctaggtacgagctgaggggaagggttgctactgcagcaggaaggatggaggccagacagatcaggcctgggataccccgagggatctgggtgcccctgactggagagtagtagcacatcttccaccaacccatccccacctgcgcaagcttcctgaaaggtcaggaaggctgcactgatgcccaggcctcacccccagccctggtgacagtgcccagcatgggctatgctcctgttcctccccccacctcactgcagcccctgctgccccagcagcctgtgttcgtagtgcaagaggtgagtcctgcatgccctggggggcaggaactgtgctgggatactttcttacaactgagggtcctgagctcccctgtctggagcaagtggtgaggcggggctggggttggggtgggaagacttttggtgtgggaagcccctacagactcagcctcaaggcctcctcccacaaagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtctgacatggcagggtgggagtggccttggactcctccctggctggggagactgcttgtgtggaacaggctggggaggaagaggataatcaacatttgctgcttcctaacgtgtgtgccaggcattgcactaaatgctttacattggcaaggcacagtggctcacgcctgtaattccagcactttgggaggccgaggtgggtggatcacctgaggtcaggagttcaagaccagcctggccaacatggtgaaacgccatctctactaaaaatacaaaaattgggccgggcgtggtgactcacgcctgtaatcccagcagtttgggaggctgaggtgggtggatcacgaggtcaagagatcgagaccatcctggctaacacgatgaaaccctgtctctactaaaaagctgaggcaggagaatggcgtgaatctgggaggcagagcttgcagtg

SEQ ID NO: 291164 - DNA, 756 bp, Homo sapiens
ctctggagtctgggagcacaaagaggggcacagggccaccaagtgggtcttggatctgccctccaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 291165 - DNA, 536 bp, Homo sapiens
tcgctctggagcgcaatctgtaataaagtcctgagcaatttctcgcaccagacgctggaaggggagtatgcgaatcagaagttcagtggacttctgataacgtctaatttcacggagcgccacagtaccaggcctgtaacgatgaggtttcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 291166 - DNA, 365 bp, Homo sapiens
gctttgggctggccctgctcaacgactgcaagtatggcgcgtcagtgcgaggcagcatcctcagcctctcgctgtaagtggggtacccaccaggcctgggagctggcatggagaaatgggtcttcccgaccacaactccaacagcttcagcgtggcccctacgcgccctcctcaccccagcttgcgggcgcctaaagccccggacgctactgctgacacggggcgccacgagttcacctatgcactgatgccgcacaagggtgagtgctggggacggtggggccttcctgcagccctagacacctctctgcccttccctgagcccaaaccccagcaacctggcttcctgccccttctagggacag

SEQ ID NO: 291167 - DNA, 678 bp, Homo sapiens
caccatcatgcctgactccttttggtatttttttgtgtagagatgtgttctcattatgttgcccaggctggtctccaactcctgaactcaagcaatccacccaccttggccttgcaaagggctgagattacaggtgtgagccaccatgcctgggcaacattgagattgatttaaagaaattgattagggctgggtgtggtggtgcacactgcttatctcaacactttgggaggcagaagtggaagatttgcttgagcccaggagcttgagaccagcctgggaggtataatgaggccttgtctctacaaagataacaataaaaacattagcatgacatgatggtatgcacctgtagttccagctatccaggaagttgaggtgggaagattgcttgaggtcaggagtttgagaccacagtgagccataatcaggcccctgcattctagccctgggttgacagagtgagacccagtttcataaaaagagattgataagaaactcttgatgcaactcattataattttaaatggaaactaattcttgatattaccttagcagtgtgtccccgagaaagtgtcagagcctttacgtggaccttctcatgaaaaaggaaacagaatagtcaatggaaaaggaaaagggcctcctgcaaaacatccttccttgaaggtaattaat

SEQ ID NO: 291168 - DNA, 361 bp, Homo sapiens
gtcttctctgcagtgggagcagctctcctgccacagctcctcaccccctgaaaatgttcgcctgctccaagtttgtctccactccccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgcca

SEQ ID NO: 291169 - DNA, 4644 bp, Homo sapiens
  misc_feature (1501)..(1501): n is a, c, g, or t
  misc_feature (2759)..(2759): n is a, c, g, or t
  misc_feature (2837)..(2837): n is a, c, g, or t
gaattccaagctcataatggagaacctcattttggaccatgggggtcaactgaagaattttaaatgaagaggaaaattaatcagtgtgcaaggttaaatggagtggcagagactaggagctattaggaatctactgcaagatgattctaacagccataggtagtgggtaaaagaggaaagtgagccaataagggaaacagaagaacaagttgaatatgtgggaatataatcaggagaatgtggagtgaacccagggattctcaacctcagcactggtgacattttgagccccactctctgttgtgggagccgtcctgtgcaatgtaggacatttagcagcatcgttggcctctacccactaaaaacgccaagtagtaaggccccatcccttagtgacaacccaaaatgtctccagacattgccaattgcctctggttgagacccactgatttatggaaatcaaaagaataatcatttccaaaagcctgacagcaaacagcaaagtccaaaaataaaatgagaacaagaccattggctttggtggttggaggtcatgagataccttcaagaaagcaccctctataatatcaagtccatgtagaagacgttacagaggaaacaaacaatataaaagtgaaaacaaccaagggtgagctactctcagaaagtatgcctttgaaaagaaagtcagaagccatagcttgggatctctgcagatccctaaaagaatagattcctattctactgactttctatgaagatcaaattgtaaaaagcaaaagtttctctccaagggtttcctttgcagtgacctgtatgtccaaccacgcaagggcccattgtggggacatatgttgtccaaaaggaccatagcagagacaggccagtgagccaaagtgtggaaacttttgagactggcttgagcttggcacttatagaacaataaaccaagcctttgaaggggttcaacaaaggaaccatttgtccactctagtagctacaaagtaaggcagggttgcagcaaagaacaaaaaaataaaagaaggccaagctggaggtatgaccaaagtttactaggtccattctgagaccttctgctagggtctgagatctagaagacagtgaataaggaaacaaacccaaaactcaacgcaacacaggatatggaagctctcaggcctgacgttaacagcatctactatttttcttctcagctactttaatgaatgcagtatactaaaagccaggaggggaagggacaacactaagcaaaaaacatgcattttttaaaatgcacagattttcttcactgccgtttttgttatcattcctatgaattagtgatgccgaatttcattttctcatctgctgaagagctttcctgtgttcctctcgttggaacacatgcttggcattaaaatgcttgtgagaacttctcttcctttaacgttccctggctagcttggtttttaatctaacagcccttctttcaaaatgatcnttccactggagatagatatttatcattctcttccttcacctcatctcttgacaggccgcacgtgacttgaaggaatttttcaaatagcagctcagccaccctgaggggcttcagtctcacccctaagttcgctggctttttcttcaccacgtccagttgctttccatcttattaactgctcttttcactagaggaccaactcagtaggaaattttttgagaggtggagaaagagatgttcaaagaaggtgttggggtcgggggaaactggttttattttatacaagtcacacattctgaatcttcccttttgtgtctctggggagaaaggagaaagtttgatcaaatcgctcattatttctgcacttctttcttttttcctaagtataaaaatatatgactactactactgtgagactatgtgattgtgagaatgaatgattcttttttttttttttttttttttgaaacggagtctctcgctgtcacccaggctggagtgcagtagcacgatcttggctcactgcaacatctgcctcccgggttcaagcaattctcctgcctcagcctcctgagtagctgggactacaggtgcgctccaccacccccagctaatttttgtatttttagtggagacggggtttcaccatgttggtcaggctggtcttgaactcctgacctcatgatcctctcacctcggcctcacaaagtgctaggattacaggcgcatggccaagaatgaatgattatttgtgccttcctatgtgaaaaaaaaatgtttcctctagctacacactattctgttctgtgaggccgccccatcagactgttgacctagagtcccaaccccggccctccaggagacctgcctgttcttagaagcccaacccactcagcagcagctccaaataacagggggagccaacaaaaaagagtgctgctagagcaacaagcaaggggcaattagtcagaaggcaacttccatggtcttccaaaaaaaattgaggtgaaagaccaaagatgtccctaaaatgtcttcctaaaagataaacttcatcaactacctctgactggtcagtattaagaaccactttcaggccaggtgtcatggttcacgcctgtaactccatctactccagaggctgaggcaggacaattgcttcaggccggaggattgcttgaggccaggagctggagaccaagcctgagcaacacagtgagacctcatctctaccaaaaatgtacctctattaaaaaanaaaaaagaagaagaagaagaagaagaaggagaggaggctgggtatggtggctaatgcctttgtaatcccagaactttngaaggctgaggcaggagaatcacttaggctgaggcaggagaatcaccagagtctaggagtttgagaccagcctgggcaacatagtgagacccccatctctacaaaaaaaaaaattcaaaaattagccaagcgtggggtttgtgcctgtagacccaactactcaggaggctcaggtaggaggatcacctgagtccagggaggtcgaggctgcagtgagtcatgattattccactgccttccagcctagactacagggtgagaccctgtcttaaaaaaaaaattaaagaagaaaaaactctcttttcttttctttctttcttcttcttcttttctttttttttttttctttttttttttttagagatggcacgtcaccacattgcccaggctgttgtcgaactcctggcctcaaacgatgctcccacttgagcctcccaaagtgctgggactacaagcataagccaccacacacggccttttcctttctttttctatttctcaatggatttttccaatggacacgtatcactttggtagttatacatgatactagttgtaatctcagccatttttcaacccagcaaatgtctattctaggtcaaatatgtctcaaaaattactaaaagaaaatcagttatgtcctttaacctggctgaggtctggctttgttttctctcatgtaaaaatggagatggcacaaaacaactccaagctgttacttgaaagtaacacctcaggtgatgtcaccagcctgagggagagtgaggttaagttctgaacccacaggcattatatctgcctggggttcacatgccctacactggactggcataatttgagagtcagatccgaagatgtggtatatccgccatctttagcaactttcaaaaactaccctatgaggtcaagctggacctacttttggttttgccattgttgtttgtttgttgttgagggttttctttgaggggcggggagtgcatgcccctgtggagagcactcatttagcttcaattagagtaatgccaaaagtgccagattcctgggaaatcagcctacaaggctcctgcgggaaggaacctccactgccagaagtccttagggcatctaagtgatcagacaccgtcagggattctttgccccgtaaaaacctacttgaccagggacacgtgccaggtaaatttccttcacatttacttcaaccttattgcatactcattttagtattaaaacctttaataaaatgctcctattccttcacactttttttctatgagatctcaaataccccttcttgctattaaaaaaaatcacttattattcaccagcccaatattttaaaagtaaaaataataagccaaggccaggagcgatgactcgcacttgtattcccagcagtttcagaggcaaaggccgaaggatcgctttaaccgaggagtttgagaccagcctgggcaacatgaccagactgcctctctacaaaaagtttaaaaaattaaccgggtgtggtggtgcactgcactcccagctactgggctggggtatcaggctgaggtaggaggtttgctttgagcccggggggatcgaggctgcagtgagctttgattgtgccactgcactccagcctgggtgacagaaggagacctgtctcaaaaataataagaataataattaataataataggccaaaccaaatacccatcaccttctgctgtgcctcccctttccccaataaatccagtgtcttgctttcaaattttgtggttaaaaaagatgatgagtttctaagacgtgggggctaaagctt

SEQ ID NO: 291170 - DNA, 1813 bp, Homo sapiens
cggcccccgccctgttcgccccgcgccaccggcccgcgccccgccatggaggacctggatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctc

SEQ ID NO: 291171 - DNA, 1810 bp, Homo sapiens
ggcacgaggggagaataaaataatcaggaggctgggtttgtgcttggctccaagcatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctc

SEQ ID NO: 291172 - DNA, 1326 bp, Homo sapiens
cctggtggcgaattcggcacgagggaggacctggatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtaagtggagccttgtgagaagggaggcagagacctgtcacagacccatctttagtgagagctgggctttatgctgttcccttttagtaagttaatctgggaagtgggtatcattattacttatgttttatggatgaggaaactgaagctctgaaccacacagcaggttagtggtagggtgaaaattccaaccatgttaccatttattgtggtcctactgtgtgccaggcactgtgccagctcctttacaaaccctcatctcatctgatcttcacaaaacactctgtggctccacccaatatctctcaggcatctacaaaggctctctcttcctccgtcagagtctggactgggttcactggtccttgttttattgactgagcagatgtgattgacaacagctgtgcctaggggttaacctagtgccccctgctagatcaagtacctgactcccagcccagaattgcccatctcagcaaaggagggtggcattgtgacttttgtggatcataggcactttcatcttcatgagtcccttcgtccattaaaataaatagatttttatgtctgtgttggtgtaaaaatgaaaat

SEQ ID NO: 291173 - DNA, 462 bp, Homo sapiens
ctcatgtataggtcaatcctggagcgcagctggaagacggaacacgggagctagatctccatcgcttacaggctgcgtgatctcgaacactggattctttattctgatcgctcagagaggactcgaaaaacgccgcgtaaatcttgcctcactgggcatgtggttgtcagagccgctctgacccgcctcacctcccactcgcaggtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacgtgagccccgcccggccgcaccgagcccgccctatctcaccaggagagctgtgggacgggcctccaccgcatgggtcccgcccc

SEQ ID NO: 291174 - DNA, 2446 bp, Homo sapiens
cggcccccgccctgttcgccccgcgccaccggcccgcgccccgccatggaggacctggatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctcaaaaaaaaaaaaaaaaaaaaaaaaaaaaaaaaaaaaaaaaaaaaaaaaaaaaaaaaaaaaaaaaaaaaaaaaaaaaaaaaaaacgaggggggccgccggcgccgactagtacccctctacgggggcgctgccacctcccgccgcacccaccgcggttgtagtagagagaggaggggccgccactaggggtgcggttatatataaagacgacgagcgcggaacgccacagaataataatacaaacagactgaagccagaaggggagaaacaaggccgcggacgagtgagaggaaactactgttgagtgacaagcagccacacccatccactaccagcggcgggggcacacacatacaaatatgaggggcgcaaacaaccctcgctccatagagagaagatatatattattagaaacaccccctcgctcgaagggggaggaaataaattatacagcagattattaagacactgagagatatgagctagtgcgagtgagtgcaaacaccaacacgcagcagcaacgttatattagcatctgttacgagggacggagagaaagagcaaaaaaaggttgcgtgatgagtaacatacgagaagatatttattattgattgtgaataaaactaattattc

SEQ ID NO: 291175 - DNA, 1789 bp, Homo sapiens
cctggtggcgaattcggcacgagggaggacctggatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctc

SEQ ID NO: 291176 - DNA, 1732 bp, Homo sapiens
cggcccccgccctgttcgccccgcgccaccggcccgcgccccgccatggaggacctggatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctc

SEQ ID NO: 291177 - DNA, 1595 bp, Homo sapiens
cggcccccgccctgttcgccccgcgccaccggcccgcgccccgccatggaggacctggatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctc

SEQ ID NO: 291178 - DNA, 1639 bp, Homo sapiens
cctcgtgcgcgctcgtgccgaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctc

SEQ ID NO: 291179 - DNA, 1258 bp, Homo sapiens
ctcatgtataggtcaatcctggagcgcagctggaagacggaacacgggagctagatctccatcgcttacaggctgcgtgatctcgaacactggattctttattctgatcgctcagagaggactcgaaaaacgccgcgtaaatcttgcctcactgggcatgtggttgtcagagccgctctgacccgcctcacctcccactcgcaggtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctc

SEQ ID NO: 291180 - DNA, 1062 bp, Homo sapiens
ctcatgtataggtcaatcctggagcgcagctggaagacggaacacgggagctagatctccatcgcttacaggctgcgtgatctcgaacactggattctttattctgatcgctcagagaggactcgaaaaacgccgcgtaaatcttgcctcactgggcatgtggttgtcagagccgctctgacccgcctcacctcccactcgcaggtggtgacggctctgggccgcgcctggcaccccgagcacttcgtttgcggaggctgttccaccgccctgggaggcagcagcttcttcgagaaggatggagcccccttctgccccgagtgctactttgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctc

SEQ ID NO: 291181 - DNA, 3431 bp, Homo sapiens
gccgcgcggcgcgggggaggagaccttcatctgttcacgcggtagcgcggattgcggttcgcggcgcgcgccaccggggaaggagcggtgggccgaggggttggaggtggggccccaggaggacctcgggctgtgggccgggagagcggagtcggggagtggggcgggggagcgaggtggcgccggggagcctgggatatggcgcggccagacgatgaggagggggcggcggtggcgcccggacacccgctcgcgaaaggatacctcccgttgccgaggggcgcgcccgttgggaaggagagcgtggagctgcagaacgggcccaaagcgggcaccttcccggtgaatggggccccccgggacagcctcgctgccgcctcgggagttctgggcgggcctcagactccactggccccagaagaggagacccaggcccggctgctgcctgcgggcgcgggagctgagaccccgggggccgagagcagcccgctgccccttacggcgctctccccgcggcgcttcgtggtgctcctgatcttcagcctgtactcgctggtcaacgcctttcagtggatccagtacagcatcattagcaacgtcttcgagggcttctacggtgtcaccttgctgcacatcgactggctgtccatggtgtacatgctggcctacgtgcccctcatcttcccggccacctggctgctggacaccagaggcctgcggctcaccgccctgctgggctccggcctcaactgcctgggtgcctggatcaagtgcggcagtgtgcagcagcatctcttctgggtcaccatgttgggccagtgcttgtgctcggtggcccaggtgttcatcctgggcttgccctcccgcatcgcctcagtgtggtttgggcccaaagaggtgtccacagcttgtgccaccgccgtgctgggcaatcagcttggaactgcagttggctttttgctaccaccagttttagtacccaacacacagaatgacacaaatctcctggcttgtaatatcagcaccatgttttatggaacatcagctgttgccacacttttatttattttaacagcaattgccttcaaagaaaaacctcggtatccaccaagtcaggctcaagcagctcttcaagacagtccccctgaagagtactcctataagaaatcaataagaaacctgtttaaaaacattccttttgtccttctgttgatcacttatggtatcatgactggtgccttttattcagtctcaacgttattaaatcaaatgatattgacatattatgagggagaagaagtcaatgctggaaggattgggctaacgctagtagtagctggaatggtgggctctattctttgtggcttatggctggattatactaaaacatacaaacagactactctgatagtttatattttgtcttttattggaatggttatctttactttcacattggaccttagatatattatcatcgtgtttgttactggaggggtgcttggcttcttcatgactggttacctccctttgggttttgaatttgctgttgaaatcacttaccctgaatctgaaggtacttcatctggtcttcttaatgcttctgcacagatatttggaattttgttcacattggctcaaggaaagctcacatcagactatggtcctaaggcagggaacatttttctctgtgtctggatgtttataggcatcatattaacagcattaatcaagtctgatctgcgaagacacaacataaatataggaattacaaatgttgatgttaaagctataccagctgacagtcccacagaccaagaaccaaaaacggttatgttgtccaagcagtcagaatcagcaatttgaagagaaaggcaaagttactgtcctgtagtaattggggacaatgtgatcatccttggagagagatgtgagcaccaaggctgggtttgtatgtggtgggggaataaacacacttacttgaaaattaccatatgaactctaaatgcataattattattttgcttaattgttaaattaagggaaattttcttaaaattcttctgtttacatcatgttaacactactgtttatctaattagtatccggtttttagtctcatattgtatctgaaagtaagcttcttgacgtttactttttaaaagtcgatgtttttcttttttgtagaaaatggaagcttagaagactttttaaagtgataatatggggtgttcagtccccataagatataatagttcatgcagtttatatattaaagtatccagtggaactaaatgtacaatatattcctaattggctgcctttttcactgtgctgaccagctgttcaagccacttcagtttgagtacaacataccaacatgacactactcacccacaaaggacagcattgggatcaggctttcagatgacctctaagatttttcccatttattgtactcttgttacaaagtactttttaacacatgcagtcaatggctataaaaactattctgtgtacagattctacccagactttggtcttagaattatgttctaattaaggagcctggttacaggttcattctgtcttgagttcttttctgtgctgcctttctatcatggataaatgctaacgctgtattttttcactccaacttgagatagagtagttttgtacccattgccttttttttcttttaaactctctttttttttttttcctgatgtgtaactttctagtaagataatttcatcatgtatgttactggctatttcatgatttcatgtatcacatcgtatattttgccttgaagattcctgaaataaggaaatctataataacttcagatagcctacatgtccccatttagtggagacctcttgaatgctatttgaattctgcagtatcatttttatgaccattctcctttgaggaatactatgcccaggtacatgctctatcagtgtgccgggagagtggattcttttcttcactgcagagtcatcacactgttggaatagtctgctcttttacatgctcaggtagggaaaataggaccaaatatatttccacagtgcctaccactgtgtcatgtttacagtgagagtttaaatattgttgatgtcctgactctgtgagctcatagggagtatcttcatagtaatgacatttgatcagccataaaatttacattatgttcatatgcacccaaaaaagctagtcaggtaatgaatacccttgaagtgaatagcaattttgatttaggcagtgtgttaggccatccttgcattgctataaagaaatatttaggctgggcgtggtggctcacgcctgtaatcccagcactttgggaggctgaagcgtgtggatcacctgaggtcaggagttcaagaccagcctggccaacatggtaaaaccccatctctact

SEQ ID NO: 291182 - DNA, 1140 bp, Homo sapiens
aaccttaggctaggtacgaggctgggtggtgattttcactgtgctgaccagctgttcaagccacttcagtttgagtacaacataccaacatgacactactcacccacaaaggacagcattgggatcaggctttcagatgacctctaagatttttcccatttattgtactcttgttacaaagtactttttaacacatgcagtcaatggctataaaaactattctgtgtacagattctacccagactttggtcttagaattatgttctaattaaggagcctggttacaggttcattctgtcttgagttcttttctgtgctgcctttctatcatggataaatgctaacgctgtattttttcactccaacttgagatagagtagttttgtacccattgccttttttttcttttaaactctctttttttttttttcctgatgtgtaactttctagtaagataatttcatcatgtatgttactggctatttcatgatttcatgtatcacatcgtatattttgccttgaagattcctgaaataaggaaatctataataacttcagatagcctacatgtccccatttagtggagacctcttgaatgctatttgaattctgcagtatcatttttatgaccattctcctttgaggaatactatgcccaggtacatgctctatcagtgtgccgggagagtggattcttttcttcactgcagagtcatcacactgttggaatagtctgctcttttacatgctcaggtagggaaaataggaccaaatatatttccacagtgcctaccactgtgtcatgtttacagtgagagtttaaatattgttgatgtcctgactctgtgagctcatagggagtatcttcatagtaatgacatttgatcagccataaaatttacattatgttcatatgcacccaaaaaagctagtcaggtaatgaatacccttgaagtgaatagcaattttgatttaggcagtgtgttaggccatccttgcattgctataaagaaatatttaggctgggcgtggtggctcacgcctgtaatcccagcactttgggaggctgaagcgtgtggatcacctgaggtcaggagttcaagaccagcctggccaacatggtaaaaccccatctctact

SEQ ID NO: 291183 - DNA, 3290 bp, Homo sapiens
gccgcgcggcgcgggggaggagaccttcatctgttcacgcggtagcgcggattgcggttcgcggcgcgcgccaccggggaaggagcggtgggccgaggggttggaggtggggccccaggaggacctcgggctgtgggccgggagagcggagtcggggagtggggcgggggagcgaggtggcgccggggagcctgggatatggcgcggccagacgatgaggagggggcggcggtggcgcccggacacccgctcgcgaaaggatacctcccgttgccgaggggcgcgcccgttgggaaggagagcgtggagctgcagaacgggcccaaagcgggcaccttcccggtgaatggggccccccgggacagcctcgctgccgcctcgggagttctgggcgggcctcagactccactggccccagaagaggagacccaggcccggctgctgcctgcgggcgcgggagctgagaccccgggggccgagagcagcccgctgccccttacggcgctctccccgcggcgcttcgtggtgctcctgatcttcagcctgtactcgctggtcaacgcctttcagtggatccagtacagcatcattagcaacgtcttcgagggcttctacggtgtcaccttgctgcacatcgactggctgtccatggtgtacatgctggcctacgtgcccctcatcttcccggccacctggctgctggacaccagaggcctgcggctcaccgccctgctgggctccggcctcaactgcctgggtgcctggatcaagtgcggcagtgtgcagcagcatctcttctgggtcaccatgttgggccagtgcttgtgctcggtggcccaggtgttcatcctgggcttgccctcccgcatcgcctcagtgtggtttgggcccaaagaggtgtccacagcttgtgccaccgccgtgctgggcaatcagcttggaactgcagttggctttttgctaccaccagttttagtacccaacacacagaatgacacaaatctcctggcttgtaatatcagcaccatgttttatggaacatcagctgttgccacacttttatttattttaacagcaattggtatcatgactggtgccttttattcagtctcaacgttattaaatcaaatgatattgacatattatgagggagaagaagtcaatgctggaaggattgggctaacgctagtagtagctggaatggtgggctctattctttgtggcttatggctggattatactaaaacatacaaacagactactctgatagtttatattttgtcttttattggaatggttatctttactttcacattggaccttagatatattatcatcgtgtttgttactggaggggtgcttggcttcttcatgactggttacctccctttgggttttgaatttgctgttgaaatcacttaccctgaatctgaaggtacttcatctggtcttcttaatgcttctgcacagatatttggaattttgttcacattggctcaaggaaagctcacatcagactatggtcctaaggcagggaacatttttctctgtgtctggatgtttataggcatcatattaacagcattaatcaagtctgatctgcgaagacacaacataaatataggaattacaaatgttgatgttaaagctataccagctgacagtcccacagaccaagaaccaaaaacggttatgttgtccaagcagtcagaatcagcaatttgaagagaaaggcaaagttactgtcctgtagtaattggggacaatgtgatcatccttggagagagatgtgagcaccaaggctgggtttgtatgtggtgggggaataaacacacttacttgaaaattaccatatgaactctaaatgcataattattattttgcttaattgttaaattaagggaaattttcttaaaattcttctgtttacatcatgttaacactactgtttatctaattagtatccggtttttagtctcatattgtatctgaaagtaagcttcttgacgtttactttttaaaagtcgatgtttttcttttttgtagaaaatggaagcttagaagactttttaaagtgataatatggggtgttcagtccccataagatataatagttcatgcagtttatatattaaagtatccagtggaactaaatgtacaatatattcctaattggctgcctttttcactgtgctgaccagctgttcaagccacttcagtttgagtacaacataccaacatgacactactcacccacaaaggacagcattgggatcaggctttcagatgacctctaagatttttcccatttattgtactcttgttacaaagtactttttaacacatgcagtcaatggctataaaaactattctgtgtacagattctacccagactttggtcttagaattatgttctaattaaggagcctggttacaggttcattctgtcttgagttcttttctgtgctgcctttctatcatggataaatgctaacgctgtattttttcactccaacttgagatagagtagttttgtacccattgccttttttttcttttaaactctctttttttttttttcctgatgtgtaactttctagtaagataatttcatcatgtatgttactggctatttcatgatttcatgtatcacatcgtatattttgccttgaagattcctgaaataaggaaatctataataacttcagatagcctacatgtccccatttagtggagacctcttgaatgctatttgaattctgcagtatcatttttatgaccattctcctttgaggaatactatgcccaggtacatgctctatcagtgtgccgggagagtggattcttttcttcactgcagagtcatcacactgttggaatagtctgctcttttacatgctcaggtagggaaaataggaccaaatatatttccacagtgcctaccactgtgtcatgtttacagtgagagtttaaatattgttgatgtcctgactctgtgagctcatagggagtatcttcatagtaatgacatttgatcagccataaaatttacattatgttcatatgcacccaaaaaagctagtcaggtaatgaatacccttgaagtgaatagcaattttgatttaggcagtgtgttaggccatccttgcattgctataaagaaatatttaggctgggcgtggtggctcacgcctgtaatcccagcactttgggaggctgaagcgtgtggatcacctgaggtcaggagttcaagaccagcctggccaacatggtaaaaccccatctctact

SEQ ID NO: 291184 - DNA, 1878 bp, Homo sapiens
gccgcgcggcgcgggggaggagaccttcatctgttcacgcggtagcgcggattgcggttcgcggcgcgcgccaccggggaaggagcggtgggccgaggggttggaggtggggccccaggaggacctcgggctgtgggccgggagagcggagtcggggagtggggcgggggagcgaggtggcgccggggagcctgggatatggcgcggccagacgatgaggagggggcggcggtggcgcccggacacccgctcgcgaaaggatacctcccgttgccgaggggcgcgcccgttgggaaggagagcgtggagctgcagaacgggcccaaagcgggcaccttcccggtgaatggggccccccgggacagcctcgctgccgcctcgggagttctgggcgggcctcagactccactggccccagaagaggagacccaggcccggctgctgcctgcgggcgcgggagctgagaccccgggggccgagagcagcccgctgccccttacggcgctctccccgcggcgcttcgtggtgctcctgatcttcagcctgtactcgctggtcaacgcctttcagtggatccagtacagcatcattagcaacgtcttcgagggcttctacggtgtcaccttgctgcacatcgactggctgtccatggtgtacatgctggcctacgtgcccctcatcttcccggccacctggctgctggacaccagaggcctgcggctcaccgccctgctgggctccggcctcaactgcctgggtgcctggatcaagtgcggcagtgtgcagcagcatctcttctgggtcaccatgttgggccagtgcttgtgctcggtggcccaggtgttcatcctgggcttgccctcccgcatcgcctcagtgtggtttgggcccaaagaggtgtccacagcttgtgccaccgccgtgctgggcaatcagcttggaactgcagttggctttttgctaccaccagttttagtacccaacacacagaatgacacaaatctcctggcttgtaatatcagcaccatgttttatggaacatcagctgttgccacacttttatttattttaacagcaattgccttcaaagaaaaacctcggtatccaccaagtcaggctcaagcagctcttcaagacagtccccctgaagagtactcctataagaaatcaataagaaacctgtttaaaaacattccttttgtccttctgttgatcacttatggtatcatgactggtgccttttattcagtctcaacgttattaaatcaaatgatattgacatattatgagggagaagaagtcaatgctggaaggattgggctaacgctagtagtagctggaatggtgggctctattctttgtggcttatggctggattatactaaaacatacaacttcttcatgactggttacctccctttgggttttgaatttgctgttgaaatcacttaccctgaatctgaaggtacttcatctggtcttcttaatgcttctgcacagatatttggaattttgttcacattggctcaaggaaagctcacatcagactatggtcctaaggcagggaacatttttctctgtgtctggatgtttataggcatcatattaacagcattaatcaagtctgatctgcgaagacacaacataaatataggaattacaaatgttgatgttaaagctataccagctgacagtcccacagaccaagaaccaaaaacggttatgttgtccaagcagtcagaatcagcaatttgaagagaaaggcaaagttactgtcctgtagtaattggggacaatgtgatcatccttggagagagatgtgagcaccaaggctgggtttgtatgtggtgggggaataaacacacttacttgaaaatt

SEQ ID NO: 291185 - DNA, 228 bp, Homo sapiens
caagaaggggtgaactttgaaaaacaaagattcattactgaacaggtaagagtgatgatttttgtattcctaggagaatcagacaaaatactaacagctttgttgtttttgttttagacagactactctgatagtttatattttgtcttttattggaatggttatctttactttcacattggaccttagatatattatcatcgtgtttgttactggaggggtgcttgg

SEQ ID NO: 291186 - DNA, 387 bp, Homo sapiens
tcaatgataatagttccttactttgacatagcaacttcaaaatattcacttatttggtcattagaataagcccgagaggcagaatgattgcatcagtatgtgattgtgactttctggtagttctttctgtaattctggatttattttcctagcttcttcatgactggttacctccctttgggttttgaatttgctgttgaaatcacttaccctgaatctgaaggtacttcatctggtcttcttaatgcttctgcacaggtaaacctctgatttctctaaacctgagatgattattataccagatattctagtgagtaatgagtttgaccatggttttatttgttgttgttgttgttttgttttttggagacagagtcttgctcagcc

SEQ ID NO: 291187 - DNA, 1989 bp, Homo sapiens
gccgcgcggcgcgggggaggagaccttcatctgttcacgcggtagcgcggattgcggttcgcggcgcgcgccaccggggaaggagcggtgggccgaggggttggaggtggggccccaggaggacctcgggctgtgggccgggagagcggagtcggggagtggggcgggggagcgaggtggcgccggggagcctgggatatggcgcggccagacgatgaggagggggcggcggtggcgcccggacacccgctcgcgaaaggatacctcccgttgccgaggggcgcgcccgttgggaaggagagcgtggagctgcagaacgggcccaaagcgggcaccttcccggtgaatggggccccccgggacagcctcgctgccgcctcgggagttctgggcgggcctcagactccactggccccagaagaggagacccaggcccggctgctgcctgcgggcgcgggagctgagaccccgggggccgagagcagcccgctgccccttacggcgctctccccgcggcgcttcgtggtgctcctgatcttcagcctgtactcgctggtcaacgcctttcagtggatccagtacagcatcattagcaacgtcttcgagggcttctacggtgtcaccttgctgcacatcgactggctgtccatggtgtacatgctggcctacgtgcccctcatcttcccggccacctggctgctggacaccagaggcctgcggctcaccgccctgctgggctccggcctcaactgcctgggtgcctggatcaagtgcggcagtgtgcagcagcatctcttctgggtcaccatgttgggccagtgcttgtgctcggtggcccaggtgttcatcctgggcttgccctcccgcatcgcctcagtgtggtttgggcccaaagaggtgtccacagcttgtgccaccgccgtgctgggcaatcagcttggaactgcagttggctttttgctaccaccagttttagtacccaacacacagaatgacacaaatctcctggcttgtaatatcagcaccatgttttatggaacatcagctgttgccacacttttatttattttaacagcaattgccttcaaagaaaaacctcggtatccaccaagtcaggctcaagcagctcttcaagacagtccccctgaagagtactcctataagaaatcaataagaaacctgtttaaaaacattccttttgtccttctgttgatcacttatggtatcatgactggtgccttttattcagtctcaacgttattaaatcaaatgatattgacatattatgagggagaagaagtcaatgctggaaggattgggctaacgctagtagtagctggaatggtgggctctattctttgtggcttatggctggattatactaaaacatacaaacagactactctgatagtttatattttgtcttttattggaatggttatctttactttcacattggaccttagatatattatcatcgtgtttgttactggaggggtgcttggcttcttcatgactggttacctccctttgggttttgaatttgctgttgaaatcacttaccctgaatctgaaggtacttcatctggtcttcttaatgcttctgcacagatatttggaattttgttcacattggctcaaggaaagctcacatcagactatggtcctaaggcagggaacatttttctctgtgtctggatgtttataggcatcatattaacagcattaatcaagtctgatctgcgaagacacaacataaatataggaattacaaatgttgatgttaaagctataccagctgacagtcccacagaccaagaaccaaaaacggttatgttgtccaagcagtcagaatcagcaatttgaagagaaaggcaaagttactgtcctgtagtaattggggacaatgtgatcatccttggagagagatgtgagcaccaaggctgggtttgtatgtggtgggggaataaacacacttacttgaaaatt

SEQ ID NO: 291188 - DNA, 3320 bp, Homo sapiens
gccgcgcggcgcgggggaggagaccttcatctgttcacgcggtagcgcggattgcggttcgcggcgcgcgccaccggggaaggagcggtgggccgaggggttggaggtggggccccaggaggacctcgggctgtgggccgggagagcggagtcggggagtggggcgggggagcgaggtggcgccggggagcctgggatatggcgcggccagacgatgaggagggggcggcggtggcgcccggacacccgctcgcgaaaggatacctcccgttgccgaggggcgcgcccgttgggaaggagagcgtggagctgcagaacgggcccaaagcgggcaccttcccggtgaatggggccccccgggacagcctcgctgccgcctcgggagttctgggcgggcctcagactccactggccccagaagaggagacccaggcccggctgctgcctgcgggcgcgggagctgagaccccgggggccgagagcagcccgctgccccttacggcgctctccccgcggcgcttcgtggtgctcctgatcttcagcctgtactcgctggtcaacgcctttcagtggatccagtacagcatcattagcaacgtcttcgagggcttctacggtgtcaccttgctgcacatcgactggctgtccatggtgtacatgctggcctacgtgcccctcatcttcccggccacctggctgctggacaccagaggcctgcggctcaccgccctgctgggctccggcctcaactgcctgggtgcctggatcaagtgcggcagtgtgcagcagcatctcttctgggtcaccatgttgggccagtgcttgtgctcggtggcccaggtgttcatcctgggcttgccctcccgcatcgcctcagtgtggtttgggcccaaagaggtgtccacagcttgtgccaccgccgtgctgggcaatcagcttggaactgcagttggctttttgctaccaccagttttagtacccaacacacagaatgacacaaatctcctggcttgtaatatcagcaccatgttttatggaacatcagctgttgccacacttttatttattttaacagcaattgccttcaaagaaaaacctcggtatccaccaagtcaggctcaagcagctcttcaagacagtccccctgaagagtactcctataagaaatcaataagaaacctgtttaaaaacattccttttgtccttctgttgatcacttatggtatcatgactggtgccttttattcagtctcaacgttattaaatcaaatgatattgacatattatgagggagaagaagtcaatgctggaaggattgggctaacgctagtagtagctggaatggtgggctctattctttgtggcttatggctggattatactaaaacatacaacttcttcatgactggttacctccctttgggttttgaatttgctgttgaaatcacttaccctgaatctgaaggtacttcatctggtcttcttaatgcttctgcacagatatttggaattttgttcacattggctcaaggaaagctcacatcagactatggtcctaaggcagggaacatttttctctgtgtctggatgtttataggcatcatattaacagcattaatcaagtctgatctgcgaagacacaacataaatataggaattacaaatgttgatgttaaagctataccagctgacagtcccacagaccaagaaccaaaaacggttatgttgtccaagcagtcagaatcagcaatttgaagagaaaggcaaagttactgtcctgtagtaattggggacaatgtgatcatccttggagagagatgtgagcaccaaggctgggtttgtatgtggtgggggaataaacacacttacttgaaaattaccatatgaactctaaatgcataattattattttgcttaattgttaaattaagggaaattttcttaaaattcttctgtttacatcatgttaacactactgtttatctaattagtatccggtttttagtctcatattgtatctgaaagtaagcttcttgacgtttactttttaaaagtcgatgtttttcttttttgtagaaaatggaagcttagaagactttttaaagtgataatatggggtgttcagtccccataagatataatagttcatgcagtttatatattaaagtatccagtggaactaaatgtacaatatattcctaattggctgcctttttcactgtgctgaccagctgttcaagccacttcagtttgagtacaacataccaacatgacactactcacccacaaaggacagcattgggatcaggctttcagatgacctctaagatttttcccatttattgtactcttgttacaaagtactttttaacacatgcagtcaatggctataaaaactattctgtgtacagattctacccagactttggtcttagaattatgttctaattaaggagcctggttacaggttcattctgtcttgagttcttttctgtgctgcctttctatcatggataaatgctaacgctgtattttttcactccaacttgagatagagtagttttgtacccattgccttttttttcttttaaactctctttttttttttttcctgatgtgtaactttctagtaagataatttcatcatgtatgttactggctatttcatgatttcatgtatcacatcgtatattttgccttgaagattcctgaaataaggaaatctataataacttcagatagcctacatgtccccatttagtggagacctcttgaatgctatttgaattctgcagtatcatttttatgaccattctcctttgaggaatactatgcccaggtacatgctctatcagtgtgccgggagagtggattcttttcttcactgcagagtcatcacactgttggaatagtctgctcttttacatgctcaggtagggaaaataggaccaaatatatttccacagtgcctaccactgtgtcatgtttacagtgagagtttaaatattgttgatgtcctgactctgtgagctcatagggagtatcttcatagtaatgacatttgatcagccataaaatttacattatgttcatatgcacccaaaaaagctagtcaggtaatgaatacccttgaagtgaatagcaattttgatttaggcagtgtgttaggccatccttgcattgctataaagaaatatttaggctgggcgtggtggctcacgcctgtaatcccagcactttgggaggctgaagcgtgtggatcacctgaggtcaggagttcaagaccagcctggccaacatggtaaaaccccatctctact

SEQ ID NO: 291189 - DNA, 446 bp, Homo sapiens
gctataatattcctttatattcatatcataaattttattaggtcaagaagctaactagtttgttcaaagtgatgatgaaaaggttagtgaaataaaagagagttatcaatagcagcttttaaagaagcttctctttgttcaaggaaacattttaatgtccaatgtaatgagaactttcttccttttctagtcttagagtgtttcttatggtgaagtccatattttcttgaaactctttatatgtattggtgatgggaattgctaaacagttattacacttgtttccaacaggaaaatccacatgcagacactcaattgaaggagtgggtttaaatccagctggaggaatggaactgcaaccagttgcaaaaataagaatgtcttccattgttgttgtagatttaccatctgaaaaaatttaccaataaaagagtaaaagaaacaaa

SEQ ID NO: 291190 - DNA, 567 bp, Homo sapiens
ggaataatcttaaaacctatctgacgctaaagttggacactgtggcatgcacctgtaatcccagctattcaggaagttgaggcatgaggatcacttgagcccaggagttcaacagcagcctgggtaacatagacttgtctctaaaaaagacttatctgagaagtacagatggagttttgctcttgttgcccaggctggagtgcaatggcgtgatctcggctcactgcaacctcatttaatcctgatgaatctgttgagatgtactttggagtcataaacacaatgccagaattttcatattgaggtgacacactaagatgaaatcgcgggaaatgttcaggaagaacttgcaatggcctcaatatactgatgctgttgcctgtgtactgtctggctgaaagcatagattaaggaaaatccacatgcagacactcaattgaaggagtgggtttaaatccagctggaggaatggaactgcaaccagttgcaaaaataagaatgtcttccattgttgttgtagatttaccatctgaaaaaatttaccaataaaagagtaaaagaaacaaa

SEQ ID NO: 291191 - DNA, 447 bp, Homo sapiens
ttttttaggattttatttttcctccatcatcattcactaccccaaagcaaaataaactaatcaactctagtaaaactgattaaccaaatgactatatgtgtagaactaggggtcagatcttgtaagactattccatcgacagctaattgacatgtatttgggagatttcccaaaacacaataagcatctgtccacagatgaaatcgcgggaaatgttcaggaagaacttgcaatggcctcaatatactgatgctgttgcctgtgtactgtctggctgaaagcatagattaaggaaaatccacatgcagacactcaattgaaggagtgggtttaaatccagctggaggaatggaactgcaaccagttgcaaaaataagaatgtcttccattgttgttgtagatttaccatctgaaaaaatttaccaataaaagagtaaaagaaacaaa

SEQ ID NO: 291192 - DNA, 486 bp, Homo sapiens
tgctaaaaacatgtagaagccttcagcagtcttgttttcttttcccaagttagagcaatcagtagagccagagagagttaatgttaacaaaataatctctggataatataggcaatacctatttatgcagacttgcagttcacaggcaaagaaaaggaaagtaaaataaaaatatcttttattttggcaagaatttactatctcaactctaaatgctattacagcaatcattaaacatctattgtttcaacagatgtactttggagtcataaacacaatgccagaattttcatattgaggtgacacactaaggtgagtcttcaacttccactatcaaattaaccaacaagagaaataaaatacaagggagaatctatttaaaactagggaacacatataaatacttcttgataacgatggaagtgaacagaactaagggatgtgaggaagaggaaaggaaactacccattggctccaccaacatct

SEQ ID NO: 291193 - DNA, 116 bp, Homo sapiens
tcaggtgggtggacttcaggcaagagcagagcagcctagaagtctgtccacccccaagggcctgagcttgggtattttagaacaggaaaagaaccacccttacttagcagtgtgca

SEQ ID NO: 291194 - DNA, 497 bp, Homo sapiens
gaatcaacacacatcattttgggaagaataaccaattcaaaaacaatcttcactatatacactgggacaacagcaagtggtgaatgagtctcttcccccttctctgtcccccacagggaaatatgtttgggagccctactctctgcccagtaattccacttctagaaagttatcctgagagaacaaccacaggtgagctcaaagactcatttataatcacgagaaactggacacaaacacaagtctacagtgagctggctaagcaaatcctaggatgggaatctggataatcagatagcaaacacctcagaggactagttattaaaatggatgaatgggcatgaaacagtaacgagtggggaaaaaaaagactggaaatacagatataaaaacattaacagtgactgtatctgattatggataatgtttttttcttctttgggcttttactattttctaaatttaaccatgtgtaaatatacctttcataatcataa

SEQ ID NO: 291195 - DNA, 475 bp, Homo sapiens
gaatcaacacacatcattttgggaagaataaccaattcaaaaacaatcttcactatatacactgggacaacagcaagtggtgaatgagtctcttcccccttctctgtcccccacagggaaatatgtttgggagccctactctctgcccagtaattccacttctagaaagttatcctgagagaacaaccacagtcaggttgtgaaggacccgtgaagatcctcactgtgaaagtgttaaccgcatgaaagaagacaggaagatctcgccagataagaccatgaaaggggaatgaaccagtacccagtgtccagctgtgctatgcagagaggcgtgattcttctccggccatctgctgtccgagtctcaacttgtttcttcaaaagattctggcaaagcagagttacataaatgaatgcaaaagttttggccaactatttccaaatattaaaaaataaagtctctttttttcctggt

SEQ ID NO: 291196 - DNA, 456 bp, Homo sapiens
gacatactgagataattagaatgccttatttcaaaagaaactatagcacttattttgttagtaggcttattgctttgcaagtccaagaattttcgtgatgtgtgcttttaatttttataacagagtccagttggcaactttgtgggaagcaatgtagtatagtggaaagagcacgggctttcaagtaagacctaggttcgaatcccggctccaacactcaccagctgtgtgaccttgagtgagtgagttactcaatttcctcatctataaaatggggatgataatatacctatttcatagggttgttgtgaggataaatgagataatgtatgtaaatcatctaagtacaatgcctggaatatagtaggcatttggtaattgttaattatttgttcagaatcaattaaaataattttcctaatgtaaatatagtaattctctttagacaaaaaagaa

SEQ ID NO: 291197 - DNA, 418 bp, Homo sapiens
gtcactggctagcaaggtagactcacacttcgccctacacacacccggagcttcacccagctctgggctgtgagaagaccctgtgctctcttgtccccatgtttcctaagagtgatgtacctgattcccttgggtttccctaacccatgactggtctgagagaagtggaaattcacacctctgttttttctcctccgactagcaccagcaggactttttgaccttcatcccagcatgctccccatcccacctccttcccatcacttgggagttcctgagtcccttcccctgctctgcaccagagcaaagaaggggtcaattgaagggatttccatcttttagaaacatacactgagcactgtgcaagaacagcagaaatagaaaccattgccccacccttaaaaagttcacacttttc

SEQ ID NO: 291198 - DNA, 814 bp, Homo sapiens
cctcactcaccaagggccgcgccggggttctgcactgtcactgcgctgcggttccccgccttagggattctcacacggttccacggctccaggcccggcggcaccgcagccatcatgcgaggcggggggacttacgaaaggcggagctacgcgagagcacgtccagcgaccggagtctggaacagttcctcgttctttctctggctctggatctgcgtccctgacagtcttaaagaggacagacctttcattcatgaggatgaccctcaacttggcccagtccatgtttcctcagactcaagccttgcattcctggcagaaagactgaagaaatgatgctgtgctcttctcagtgcttcgcgtcaggaggctctactctctcaaccggccccactattgacgcagcctcatcctgtcacctgggctggagtgcaatggcgtgatctcggctcactgcaaccttcatctcccgtgttcaaacgattctcctgcctcagcctcccaagtagctggaattacaagcacctgccaccatgcccagctaatttttgtatttttaggagagatggggtttcaccatgttggccaggctggtctcaaactcctgacctggtgatctgcccaccttggcctcccaaagttctgggattacaggcgtgagccactgtgcccggccgagactgttaagattttattgccctagtaccagcagttatgatgttctatagaacttatagctgagcccatgccagggattccccagctcactgaagctggaaggaagccaactggactgccgagttcactttaggaa

SEQ ID NO: 291199 - DNA, 734 bp, Homo sapiens
cctcactcaccaagggccgcgccggggttctgcactgtcactgcgctgcggttccccgccttagggattctcacacggttccacggctccaggcccggcggcaccgcagccatcatgcgaggcggggggacttacgaaaggcggagctacgcgagagcacgtccagcgaccggagtctggaacagttcctcgttctttctctggctctggatctgcgtccctgacagtcttaaagaggacagacctttcattcatgaggatgaccctcaacttggcccagtccatgtttcctcagactcaagccttgcattcctggcagaaagactgaagaaatgatgctgtgctcttctcagtgcttcgcgtcaggaggctctactctctcaaccggccccactattgggcatcttgagacaatgttctgcctacacaaaattctaaactgagaggagtggctcagaagctctactaacatggaatcacatgtgggttgcaggaggctggagactatcccagcagcacatggcacaaagcaagaaccagccccggacaggacgccattccatcacaggtgcactcacacccaccagcactcactcagactgggcccatttagacacaccgattcatccaacatgcatatctctggggtgtggaaggaaactggattacctggtgaaaacccacacagacatggggagaacatgccagctctacacaaacagtggcctggtggg

SEQ ID NO: 291200 - DNA, 3184 bp, Homo sapiens
  misc_feature (3)..(4): n is a, c, g, or t
  misc_feature (6)..(7): n is a, c, g, or t
ggnngnngcgcgccctggtgacagctcgcgcgtgctgatgatggcgattctttggatgggaagagaccttgaaaggacctctagtttatcctgcaactccagtcaatatcccacttaaatcattccaggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggaccactccatcctgaaccctcagaagtggtgctgcttagagtgtgccaccaccgagtccgtgtgggcctgcctcaagtgctcccacgtggcctgcggccgctatattgaggaccacgccctgaaacactttgaggagacgggacacccgctagccatggaagtccgggatctctacgtgttctgttacctgtgcaaggactacgtgctcaatgataacccagagggggacctgaagctgctaagaagctccctcctggcggtccggggccagaaacaggacacgccggtgagacgtgggcggacgctgcggtccatggcttcgggtgaggacgtggtcctgccgcagcgcgctcctcagggacagccgcagatgctcacggctctgtggtaccggcgtcagcgcctgctggccaggacgctgcggctgtggttcgagaagagctcccggggccaggcgaagctggagcagcggcggcaggaggaggccctggagcgcaagaaggaggaggcgcggaggcggcggcgcgaggtgaaacggcggctgctggaggagctggccagcacccctccgcgcaagagtgcacggctgctcctgcacacgccccgcgacgcgggcccggctgcctcgcgccccgccgccctccctacctcacgcagagtgcccgccgccacactcaagctgcgtcgccagccggccatggccccaggcgtcacgggcctgcgcaacctgggcaacacctgctacatgaactccatcctccaggtgctcagccacctccagaagttccgagaatgtttcctcaaccttgacccttccaaaacggaacatctgtttcccaaagccaccaacgggaagactcagctttctggcaagccaaccaacagctcggccacggagctgtccttgagaaatgacagggccgaggcatgcgagcgggagggcttctgctggaacggcagggcctccattagtcggagtctggagctcatccagaacaaggagccgagttcaaagcacatttccctctgccgtgaactgcacaccctcttccgagtcatgtggtccgggaagtgggccctagtgtcgcccttcgccatgctccactcagtgtggagcctgatccctgccttccgcggctacgaccaacaggacgcgcaggaatttctctgcgagctgctgcacaaggtgcagcaggaactcgagtctgagggcaccacacgccggatcctcatccccttctcccagaggaagctcaccaaacaggtcttaaaggtggtgaataccatatttcatgggcagctgctcagtcaggtcacatgtatatcatgcaattacaaatccaataccattgagcccttttgggacctatccctggaattccctgaacgctatcactgcatagaaaaggggtttgtccctttgaatcaaacagagtgcttgctcactgagatgctggccaaattcacagagacagaggccctggaagggagaatctacgcttgtgaccagtgtaacagcaaacgacgaaaatccaatcccaaaccccttgttctgagtgaagctagaaagcagttaatgatctacagactacctcaggttctccggctgcaccttaaaagattcaggtggtctggccgtaatcatcgagagaagattggggtccatgtcgtctttgaccaggtattaaccatggaaccttactgctgcagggacatgctctcctctcttgacaaagagacctttgcctatgatctctccgcagtggtcatgcatcacgggaaagggtttggctcaggacactacacagcctattgctacaacacagagggaggtgcgtgcgctttactctgtggggtgggggacacggaaaggggttgatttgtccacattttattgttttccttttatttccatcccatggattacctagagggaaattacatacatcaaaaatccagtggaaagaattgtgaaaattgggttgggcgccgtggctcacacctgtaatcctagcgctttgggaggccgcggtgggtggatcacctgaggtcaggagttcgagaccagcctggccaacatggttaaaccccgtctctactaaaatagtacaaaaattagccgggcgtggtggtgggcactggtaatcccaggtactcaagaggctgaggcaggagaatcgcttgaacctgggaggcagaggttgcagtgagccaagattatgccactgcacttcagcctgggtgacagagcaagactcttatctcaaaaaaaataaaaagaattatgaaagttggattcaaattttgggtatattactaagtaacaacatatggttgttctaagaattaaaaggaactgacatgtaaaagtgcttagaacaggacctaggccctgtgcaatggctcacacctgtaattccaacactttgggaggcagaggcgggaggattgcttgaggccgagggttcaagactagcctgggcaacatagcgagactgcatctctacaaaaaatttaaaaattatccaggtgtaatggtgtgcacctgtgatcctagctacttgggaggctgaggtgggagaattgctcaagcccaggagtttgaagttgcaatgagctatgatttcaccactgcattctagcctgggcaacagagtgagatcctgactcaaataaataaataagaagagcagttgcctaccacatagtacttattcagtcagtgttagaggatattgtagtattatcaaaagtattggttattgataatattactgttttgtggtaatgctacttctgcacaccccagtttccttcttggttatgcagaaacagtagaacctgtgtaacctcaaggagatattgtatgaatctcactagccgcagcttataataaagccgagaacattt

SEQ ID NO: 291201 - DNA, 1555 bp, Homo sapiens
tcttctttctttctttttatatatatatatgtactccaatttaaaacttttaattaaaaagtaaactttaatgtcgaaaatgcaaacttggggaggacagaaagataacacacaaggctgtcacttcatacttggatggttgcacagcagtcgcgcagaggcactcctcacttcccagacggggcggcggccaggcagaggggctccttacttcccagatggggcggcggacgcccggccgggaacatattttcttaaagtttcttcgaagaggaactctgtgttagctgttaggatgacacaatagagaattttctttcctcttacagtggtggcccagcttgccgatctcaagcttaatactgagtcctacttcctgataatgtgtcagaaaccttaaacatgcttatacatataatttgtcaaaatcataaactctagatgtctttggctaatatattgtccttgtgtacagaatatataccgcttttaaagaagcatgccgcttacatataggtcataaacccacttagcacaaaagagtcaccacctcatgccatcttgttatatattttgcttacgcaaaaataattttagcttttgatattcgagtatttttgttaccatgaatttgtgtgttttttcctgagtttcagattgtatgcaaatataatgtgtaatttttaagacctaaaacaaatgcagaagtgctttttttcaggaagtaaacctttaatacttccatttgtagatcagtctacccataagtgactgactctttggttactcttagctgaaaagaaagatcacagttttttttttactcttacatcagttttaaggacttgtagggagtttaatgcattgtaatttactggtccttttttgaatttgtattacaattaatgaaattgcttttttcatgccatgtattagcccaatcttacagattgtttcccacttgtaggtaatagagaagaggaaacctaaccaatgactgtggaataatatggaagaagatggaaaaaacttgtttaatgggtaagaaataaaaactgtaataaaacattattaatgaaagctatttataataatagtattatgtgtggctgaggttggcatactatgagggtaattgatcagttactgttttgtctaactccattctgaactttcaccgcttgctttcatcttaaccttgtgaattttttagtaccacgaattaacttaagctaagaggggacacagccatatttgaagttaaaatgggacctaaagaccagcaaccatactgaaacaagtctagggtaggtcttgaaacttggtggtaagatagagatcgtatctgtcatgacctgtcaagagtaattatctaccccttctttttctccaaatatgtcagttgctatgatgtttgtcccaccacgaggatcccgttcatttgagcaagtgcagatgtgtgtctggtggtaatcaaatagaattctgctttgggaggttgaggtgggaggatggcttgaggcccggaattcttttatttatttatttagttttg

SEQ ID NO: 291202 - DNA, 2302 bp, Homo sapiens
  misc_feature (1)..(3): n is a, c, g, or t
  misc_feature (176)..(176): n is a, c, g, or t
  misc_feature (282)..(282): n is a, c, g, or t
  misc_feature (1014)..(1014): n is a, c, g, or t
  misc_feature (1306)..(1306): n is a, c, g, or t
  misc_feature (1924)..(1924): n is a, c, g, or t
  misc_feature (2002)..(2002): n is a, c, g, or t
  misc_feature (2164)..(2164): n is a, c, g, or t
  misc_feature (2183)..(2183): n is a, c, g, or t
  misc_feature (2188)..(2188): n is a, c, g, or t
  misc_feature (2244)..(2244): n is a, c, g, or t
nnncattgtgtacactcagatgcacaaagatactttttttttcaaagttgggtaaattttggattgacacttttgctggtgtttgtataaataacaaagattaggtttatgacttttgtagtagttaacaaagattagattttgatttgtggatttgagcaacaatggttaatgtntaatttagaaaactctttctgcattcagctactgtgttagtggcatagtatttagtttatggtttgtttcctggattgtattaagcaagtgttcaaggttactagntgtatttagcaatttaacagaggatcttggtaaaaattactatttttgccactacattttaaaaggattagtttgataatgttgactttcaagatgaagaataactttgatatgaggcacttgtttcagtgagatgtgtgtgcatattctttttatagatgtgtttgggctggcgttagtagtaggacgtactctgtatggtattgccatgtttataatgtaattgtaattgtttaatgctcaatatctttatataagtgattatagacttatttgatattggtaaagaaggaaatataaactgtaagatcagccaagggaaagagtgagtcctgccttttgtttctgtatgcaacggccttagtgtgctaaacactgagtctcattgtcaatggttatttctcagtcgctatttctaaaactgaaaatggatttttaaaaattgagataatactatttatcaataaggactccaatgataaatttaagctttattttcatttgttcatcaagtacagttctacccaatttaactttattttggttataatcttatttgctaagcaaaagcttttaagtttatatttttagatttattaggctgtacataattaaatgttttcctggttaaccgtagattctttggatgggaagagaccttgaaaggacctctagtttatcctgcaactccagtcaatatcccacttaaatcattccaggtagataaaaatntatcctattttttaaaacaaatcttcagcagtaatgtggtaacctctgtagataatctttgcaagcatttaataatttctctatcaggagagtctgccttctctccaaccagcacatgtttaatgctatatatgtgtttgtttcctcttgccccattctcaatttttgagtaaaaaatacctgtgtacttttgtatttataagaccttagttcttcataaacttaataatagtagccaacacacatataatgcttttgtgccagatacttctgtaagcactgcaaattgtancttgtttactcctcaatggcaatcctgtgaggtaggtactattactattctcattttacaggtgatgaaatagagggtccttgagattaaatgatttgcccaaggttatactcagacattcctacaactatttatttggtaattatcttatattacaaataatactatgttttgtaacccagtgatacatttaatctttattttagttcaaaagctagaattctaccaagtggtgggatgggattccagcctttgcattttgccagcagagtctgtgctctggttttgcctctggcttgcctgttgtgaagttctccctcaccaagttcttcttcagattcaacacttaacaagtcttgtttgccaatctttaaaaattatccctgtagtcctgttactaaccttttatccagttcctttctagatgaggaacctggggtaaacaccgtaacgattatgtataatgtaaagattacatcaaggttgttgcatgcttctattttttcattccaaaattgtatttacaaaacaaacccaaaccagtaaaaaatgccttattgcattgcagattccccatccacctttttagctagaaaactgccctggacttgttatatnctatgacacatttatagttgaaagattattgctgtttgaagaaaaatggattttttctgatttcagatttcagtgcanatatccataagcaaaatctgtttataccctcactaattttttagtattttctctttatgtgtgcctaagtgatataccaatttccccatatattattattatgattattatgattattattgaaaccctgtctctgctaaaaatacaaaaattagctgggcntgatggtgcatgcccgtantcccngctacttgggtggttgaggaacaagatttgcttgaacctgggaggcggaggttgcngtgagctgagattgtgccactccattccagcctggatgacagagtgacactgcatctc

SEQ ID NO: 291203 - DNA, 3103 bp, Homo sapiens
  misc_feature (3)..(4): n is a, c, g, or t
  misc_feature (6)..(7): n is a, c, g, or t
ggnngnngcgcgccctggtgacagctcgcgcgtgctgatgatggcgattctttggatgggaagagaccttgaaaggacctctagtttatcctgcaactccagtcaatatcccacttaaatcattccaggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggaccactccatcctgaaccctcagaagtggtgctgcttagagtgtgccaccaccgagtccgtgtgggcctgcctcaagtgctcccacgtggcctgcggccgctatattgaggaccacgccctgaaacactttgaggagacgggacacccgctagccatggaagtccgggatctctacgtgttctgttacctgtgcaaggactacgtgctcaatgataacccagagggggacctgaagctgctaagaagctccctcctggcggtccggggccagaaacaggacacgccggtgagacgtgggcggacgctgcggtccatggcttcgggtgaggacgtggtcctgccgcagcgcgctcctcagggacagccgcagatgctcacggctctgtggtaccggcgtcagcgcctgctggccaggacgctgcggctgtggttcgagaagagctcccggggccaggcgaagctggagcagcggcggcaggaggaggccctggagcgcaagaaggaggaggcgcggaggcggcggcgcgaggtgaaacggcggctgctggaggagctggccagcacccctccgcgcaagagtgcacggctgctcctgcacacgccccgcgacgcgggcccggctgcctcgcgccccgccgccctccctacctcacgcagagtgcccgccgccacactcaagctgcgtcgccagccggccatggccccaggcgtcacgggcctgcgcaacctgggcaacacctgctacatgaactccatcctccaggtgctcagccacctccagaagttccgagaatgtttcctcaaccttgacccttccaaaacggaacatctgtttcccaaagccaccaacgggaagactcagctttctggcaagccaaccaacagctcggccacggagctgtccttgagaaatgacagggccgaggcatgcgagcgggagggcttctgctggaacggcagggcctccattagtcggagtctggagctcatccagaacaaggagccgagttcaaagcacatttccctctgccgtgaactgcacaccctcttccgagtcatgtggtccgggaagtgggccctagtgtcgcccttcgccatgctccactcagtgtggagcctgatccctgccttccgcggctacgaccaacaggacgcgcaggaatttctctgcgagctgctgcacaaggtgcagcaggaactcgagtctgagggcaccacacgccggatcctcatccccttctcccagaggaagctcaccaaacaggtcttaaaggtggtgaataccatatttcatgggcagctgctcagtcaggtcacatgtatatcatgcaattacaaatccaataccattgagcccttttgggacctatccctggaattccctgaacgctatcactgcatagaaaaggggtttgtccctttgaatcaaacagagtgcttgctcactgagatgctggccaaattcacagagacagaggccctggaagggagaatctacgcttgtgaccagtgtaacagtgagtgctgtgtggaggagggggcgtagtggggaagaataattggaatatcagtttaaggtgctgctttgtcctctttagtcaaaagtaacactaatgatattgaatggttctaaagcatcttttaaagatctttttctcccatttttctaaaaacaaaaaaacatggacttgttttaattatgtattaaaaaacaaaacaaggctgggcgttgtggctcacgcctgtaatcccagcattttgggaggccaaggcggacagatcacttgaggtcaggagtttgagaccagcctgaccaacatggtgaaaccctgtctctactaaaaatacaaaaattagctgggcatagtggcagatgcctgtaatcccagctactcgggaggctgaggcaggagaatcggttgaacccaggaagcggagggtgcagtgagccaagatcgcgccattgcactccagcctgggcaacagagcaagactccgtttcaaacaacaacaacaacaacaaatgaaacaaagacctaggagttgattgacctcctgattgacattagttgtcatcttggaagggattttaaagttgtggctcctgaaatggggactctgagaatgttagtacttagcttcttagtgctgtggggctgctgcttaaattcatgaatgtagagtctgacagttcttacttaatctaaacccagatggtatagcctttctgaagggtgcgatatcagaaaagcaagcttttgtactgaactggtagacttaatgtctgtcaaaagtgatgctaaagattggtacagtggaaccaagaaagcaagtcttaaggtgcattgctcagtggcagcttcatgaaatattttctgcattttgtttttattgttcacatgcctgaaaagttcacatttcagagagggtcatacggaagtatttctgtgttgtctgtaattttaaaatggaactcttacatatggttacagaggcatgttatcagggtccttccatcttgccacactaacacttaatgcttctgctaatccagtatggacagaggaaatgcagaacaaatatgtggatgcttatgtttggggtttgtggcatatatagatttggaaactaaaagtataaagttaatggactgtgcagagacctagaaatcaattttcagtcacataatagtttagattaccagttttgaagaaaaaaaaaatcttaggccaggtgcagtggctcatgcctgtaatcccaggactttgggagaccccaaggtgggcgccactgcactccagcctgggtgacagagcgagatgctgtctc

SEQ ID NO: 291204 - DNA, 3025 bp, Homo sapiens
  misc_feature (3)..(4): n is a, c, g, or t
  misc_feature (6)..(7): n is a, c, g, or t
ggnngnngcgcgccctggtgacagctcgcgcgtgctgatgatggcgattctttggatgggaagagaccttgaaaggacctctagtttatcctgcaactccagtcaatatcccacttaaatcattccaggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggaccactccatcctgaaccctcagaagtggtgctgcttagagtgtgccaccaccgagtccgtgtgggcctgcctcaagtgctcccacgtggcctgcggccgctatattgaggaccacgccctgaaacactttgaggagacgggacacccgctagccatggaagtccgggatctctacgtgttctgttacctgtgcaaggactacgtgctcaatgataacccagagggggacctgaagctgctaagaagctccctcctggcggtccggggccagaaacaggacacgccggtgagacgtgggcggacgctgcggtccatggcttcgggtgaggacgtggtcctgccgcagcgcgctcctcagggacagccgcagatgctcacggctctgtggtaccggcgtcagcgcctgctggccaggacgctgcggctgtggttcgagaagagctcccggggccaggcgaagctggagcagcggcggcaggaggaggccctggagcgcaagagtgcacggctgctcctgcacacgccccgcgacgcgggcccggctgcctcgcgccccgccgccctccctacctcacgcagagtgcccgccgccacactcaagctgcgtcgccagccggccatggccccaggcgtcacgggcctgcgcaacctgggcaacacctgctacatgaactccatcctccaggtgctcagccacctccagaagttccgagaatgtttcctcaaccttgacccttccaaaacggaacatctgtttcccaaagccaccaacgggaagactcagctttctggcaagccaaccaacagctcggccacggagctgtccttgagaaatgacagggccgaggcatgcgagcgggagggcttctgctggaacggcagggcctccattagtcggagtctggagctcatccagaacaaggagccgagttcaaagcacatttccctctgccgtgaactgcacaccctcttccgagtcatgtggtccgggaagtgggccctagtgtcgcccttcgccatgctccactcagtgtggagcctgatccctgccttccgcggctacgaccaacaggacgcgcaggaatttctctgcgagctgctgcacaaggtgcagcaggaactcgagtctgagggcaccacacgccggatcctcatccccttctcccagaggaagctcaccaaacaggtcttaaaggtggtgaataccatatttcatgggcagctgctcagtcaggtcacatgtatatcatgcaattacaaatccaataccattgagcccttttgggacctatccctggaattccctgaacgctatcactgcatagaaaaggggtttgtccctttgaatcaaacagagtgcttgctcactgagatgctggccaaattcacagagacagaggccctggaagggagaatctacgcttgtgaccagtgtaacagtgagtgctgtgtggaggagggggcgtagtggggaagaataattggaatatcagtttaaggtgctgctttgtcctctttagtcaaaagtaacactaatgatattgaatggttctaaagcatcttttaaagatctttttctcccatttttctaaaaacaaaaaaacatggacttgttttaattatgtattaaaaaacaaaacaaggctgggcgttgtggctcacgcctgtaatcccagcattttgggaggccaaggcggacagatcacttgaggtcaggagtttgagaccagcctgaccaacatggtgaaaccctgtctctactaaaaatacaaaaattagctgggcatagtggcagatgcctgtaatcccagctactcgggaggctgaggcaggagaatcggttgaacccaggaagcggagggtgcagtgagccaagatcgcgccattgcactccagcctgggcaacagagcaagactccgtttcaaacaacaacaacaacaacaaatgaaacaaagacctaggagttgattgacctcctgattgacattagttgtcatcttggaagggattttaaagttgtggctcctgaaatggggactctgagaatgttagtacttagcttcttagtgctgtggggctgctgcttaaattcatgaatgtagagtctgacagttcttacttaatctaaacccagatggtatagcctttctgaagggtgcgatatcagaaaagcaagcttttgtactgaactggtagacttaatgtctgtcaaaagtgatgctaaagattggtacagtggaaccaagaaagcaagtcttaaggtgcattgctcagtggcagcttcatgaaatattttctgcattttgtttttattgttcacatgcctgaaaagttcacatttcagagagggtcatacggaagtatttctgtgttgtctgtaattttaaaatggaactcttacatatggttacagaggcatgttatcagggtccttccatcttgccacactaacacttaatgcttctgctaatccagtatggacagaggaaatgcagaacaaatatgtggatgcttatgtttggggtttgtggcatatatagatttggaaactaaaagtataaagttaatggactgtgcagagacctagaaatcaattttcagtcacataatagtttagattaccagttttgaagaaaaaaaaaatcttaggccaggtgcagtggctcatgcctgtaatcccaggactttgggagaccccaaggtgggcgccactgcactccagcctgggtgacagagcgagatgctgtctc

SEQ ID NO: 291205 - DNA, 716 bp, Homo sapiens
  misc_feature (3)..(4): n is a, c, g, or t
  misc_feature (6)..(7): n is a, c, g, or t
ggnngnngcgcgccctggtgacagctcgcgcgtgctgatgatggcgattctttggatgggaagagaccttgaaaggacctctagtttatcctgcaactccagtcaatatcccacttaaatcattccaggtaatagagaagaggaaacctaaccaatgactgtggaataatatggaagaagatggaaaaaacttgtttaatgggtaagaaataaaaactgtaataaaacattattaatgaaagctatttataataatagtattatgtgtggctgaggttggcatactatgagggtaattgatcagttactgttttgtctaactccattctgaactttcaccgcttgctttcatcttaaccttgtgaattttttagtaccacgaattaacttaagctaagaggggacacagccatatttgaagttaaaatgggacctaaagaccagcaaccatactgaaacaagtctagggtaggtcttgaaacttggtggtaagatagagatcgtatctgtcatgacctgtcaagagtaattatctaccccttctttttctccaaatatgtcagttgctatgatgtttgtcccaccacgaggatcccgttcatttgagcaagtgcagatgtgtgtctggtggtaatcaaatagaattctgctttgggaggttgaggtgggaggatggcttgaggcccggaattcttttatttatttatttagttttg

SEQ ID NO: 291206 - DNA, 669 bp, Homo sapiens
cggcttgggcggaggaggatgtcaccccagcgggtgggagctgggatcgaaccccgccgcggcctcccgcttccacccaaccccgacggggccatgggcagtggggaagggggacgcgcgcccagtgacgtcatcgaatcccgagtccggccttcgccgctgtcgtcacagaggggctgcgctgcgtcactgcattcctcccctgacgtcagcgcaagaagccagaaactggcccaccgagcgagagagaagtctggagcggagtcttcctttctcgcctttttaatttgagacggggtttcgccatgttggccagactggtctcgaactcctgacctcagctgatccacctgcctaggcctcacaaagtgctggaattataggtgtgagccaccgtgcccggcctgatctcattggatctttgcagcaatttgatgaattgggtgttctcgttatccccaggtgacaggcaactgaggcccagaagaaggttggtaatatgttaatgagttaagacatagcgccagggttcatgtgggtgagggtctgacaccagacagatgaagggtcgtcggctacagtgacttgagtacccgagctgggccagatttggacccgatggtgtgaggaacctccacccctctaatgctggcagaaaggagtttgggg

SEQ ID NO: 291207 - DNA, 618 bp, Homo sapiens
cggcttgggcggaggaggatgtcaccccagcgggtgggagctgggatcgaaccccgccgcggcctcccgcttccacccaaccccgacggggccatgggcagtggggaagggggacgcgcgcccagtgacgtcatcgaatcccgagtccggccttcgccgctgtcgtcacagaggggctgcgctgcgtcactgcattcctcccctgacgtcagcgcaagaagccagaaactggcccaccgagcgagagagaagtctggagcggagtcttcctttctcgcctttttaatttggtaagacatgtaaagtgtacgcaagagcggactacaactcccaatcggccttgcgtgccgagcatgcgcacggcctccagccagagagcgcggcaaacctttggtagattgacgtccctttagtcgaaccaggaggccggttttacatcggcaaaccaatcccgtcctcacgagtcctacccctttattcttaaccagctgcttccctgccggagtgacgggcccggctgcctttgagggttcagtttcttttgatggacattcatactgataaatcagatcgccgggaagtccagagggtgttgaaaagcgtgcatcggaactaata

SEQ ID NO: 291208 - DNA, 379 bp, Homo sapiens
ggctcactgcaacttccatctccacggctcaagggattctcctgacctcagctgatccacctgcctaggcctcacaaagtgctggaattataggtgtgagccaccgtgcccggcctgatctcattggatctttgcagcaatttgatgaattgggtgttctcgttatccccaggtgacaggcaactgaggcccagaagaaggttggtaatatgttaatgagttaagacatagcgccagggttcatgtgggtgagggtctgacaccagacagatgaagggtcgtcggctacagtgacttgagtacccgagctgggccagatttggacccgatggtgtgaggaacctccacccctctaatgctggcagaaaggagtttgggg

SEQ ID NO: 291209 - DNA, 2065 bp, Homo sapiens
tggcacgaggcaggatgtaccaaacgtggaagcggagacggggaggtctgggggtgccacgcaagtccctttcctcccgacacgagtgcagtaaagaaaaacggttatgagcgtaaagtgacagcctcggccgatgggaatagggggaagtccgacactgagcaacgaacgcattcccgcgcctccaaaacctaggccgggggcgctggaaacccttaccggcacccggccaccgcggcagacgcttgctcctgccacgcccccccccctcccccgcatcacgtgtctgcactcgctttcctcggattcccggatgtggttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagac

SEQ ID NO: 291210 - DNA, 1892 bp, Homo sapiens
tggcacgaggcaggatgtaccaaacgtggaagcggagacggggaggtctgggggtgccacgcaagtccctttcctcccgacacgagtgcagtaaagaaaaacggttatgagcgtaaagtgacagcctcggccgatgggaatagggggaagtccgacactgagcaacgaacgcattcccgcgcctccaaaacctaggccgggggcgctggaaacccttaccggcacccggccaccgcggcagacgcttgctcctgccacgcccccccccctcccccgcatcacgtgtctgcactcgctttcctcggattcccggatgtggttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagagatggggttttaccatgttgtccagtctggttttgaacttcgggattcaagcaatccgccagcctcagcgtcccaaagtgctggaattacaagtgtgagctaccaccactggcagttaagaattttaacaatttgtcaatgaaacaagaatctcaattagagtctttatatacaatctgtactgttggaattttcaaataaatattgtaaagaaaatt

SEQ ID NO: 291211 - DNA, 2098 bp, Homo sapiens
aacggcgggaaggctcaggggcgtgcttgcggcaaccctgtaaccgccggtgcgcaagttggaggggcaaggggctgccgtgtcctggtctggaggcggcccaggctgccttggtgattctggcttcgcggcctcatggcttgcggccggtttgcgcaacggcctgcgaaccaccaggcgtgtcaccgccggcttgggtccgccccgaagcccagtccctcggcctggcccgctatgccctgcacactggcggagtctggcgtggcgcagcccggcgtggggttcggccccgccaggtggtcagcccttcctcggagtccaggtggctgggggcgcttcggagagtggccagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagac

SEQ ID NO: 291212 - DNA, 1808 bp, Homo sapiens
ggctgcctttcggtggagagaggatgttgcatgcaggaagctctatgagcctgtcttcaggattgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagac

SEQ ID NO: 291213 - DNA, 2011 bp, Homo sapiens
tggcacgaggcaggatgtaccaaacgtggaagcggagacggggaggtctgggggtgccacgcaagtccctttcctcccgacacgagtgcagtaaagaaaaacggttatgagcgtaaagtgacagcctcggccgatgggaatagggggaagtccgacactgagcaacgaacgcattcccgcgcctccaaaacctaggccgggggcgctggaaacccttaccggcacccggccaccgcggcagacgcttgctcctgccacgcccccccccctcccccgcatcacgtgtctgcactcgctttcctcggattcccggatgtggttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcatatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagac

SEQ ID NO: 291214 - DNA, 1839 bp, Homo sapiens
cagcaatcctattctttgcttctggtaatttattaatttacattaatgtcatttaattatttacttcaggtagatttacatctgctatatttttacatgaaaaagatgaaaagccacttgaacatatcttctgtttttttaatgatctgttcttctttataggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagac

SEQ ID NO: 291215 - DNA, 2353 bp, Homo sapiens
tggcacgaggcaggatgtaccaaacgtggaagcggagacggggaggtctgggggtgccacgcaagtccctttcctcccgacacgagtgcagtaaagaaaaacggttatgagcgtaaagtgacagcctcggccgatgggaatagggggaagtccgacactgagcaacgaacgcattcccgcgcctccaaaacctaggccgggggcgctggaaacccttaccggcacccggccaccgcggcagacgcttgctcctgccacgcccccccccctcccccgcatcacgtgtctgcactcgctttcctcggattcccggatgtgggtgagttcatttgctcgcgtgcaggggaagtctggagaaggcattgtttcaattattaaaagtgtgggggcagtgggcggaacaaacgcgccgactacagaggctggacgtaagcttagcggtggcgcgcgtgcgcagcgccggcccgagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataaggccacgggaagaatctctggcagaaaagaagtacacctctcaagggcagggggacttagacagtgtgctctcccagttgaattttacccatactagtgaggaccttctgcaggcagaggtgacttgtcttgaaggcagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagac

SEQ ID NO: 291216 - DNA, 2287 bp, Homo sapiens
tggcacgaggcaggatgtaccaaacgtggaagcggagacggggaggtctgggggtgccacgcaagtccctttcctcccgacacgagtgcagtaaagaaaaacggttatgagcgtaaagtgacagcctcggccgatgggaatagggggaagtccgacactgagcaacgaacgcattcccgcgcctccaaaacctaggccgggggcgctggaaacccttaccggcacccggccaccgcggcagacgcttgctcctgccacgcccccccccctcccccgcatcacgtgtctgcactcgctttcctcggattcccggatgtgggtgagttcatttgctcgcgtgcaggggaagtctggagaaggcattgtttcaattattaaaagtgtgggggcagtgggcggaacaaacgcgccgactacagaggctggacgtaagcttagcggtggcgcgcgtgcgcagcgccggcccgaggggcccccaaacccggggccgcagagcagtaccagtccgtggcctgttaggaaccaggctacagagcaggagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagac

SEQ ID NO: 291217 - DNA, 2065 bp, Homo sapiens
aggctagtgcgaggcgggtgttgaatcggccgaggcaggggctgccgtgtcctggtctggaggcggcccaggctgccttggtgattctggcttcgcggcctcatggcttgcggccggtttgcgcaacggcctgcgaaccaccaggcgtgtcaccgccggcttgggtccgccccgaagcccagtccctcggcctggcccgctatgccctgcacactggcggagtctggcgtggcgcagcccggcgtggggttcggccccgccaggtggtcagcccttcctcggagtccaggtggctgggggcgcttcggagagtggccagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagac

SEQ ID NO: 291218 - DNA, 1913 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291219 - DNA, 1872 bp, Homo sapiens
cccgtcgccaacattccttcgttcccctaaatcagcctcttgccccattgctctttgcaggggtagaagaaggaagtgtagcggggtaaggaatgcaccgtcagggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291220 - DNA, 1606 bp, Homo sapiens
aaggctggtacgcccgggggtttggatctttgcaggggtagaagaaggaagtgtagcgggccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291221 - DNA, 1253 bp, Homo sapiens
  misc_feature (1115)..(1115): n is a, c, g, or t
  misc_feature (1124)..(1124): n is a, c, g, or t
  misc_feature (1126)..(1126): n is a, c, g, or t
  misc_feature (1139)..(1139): n is a, c, g, or t
  misc_feature (1253)..(1253): n is a, c, g, or t
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacacttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggccgcgaaacctgnttttttggnanaatgccaggcccnggggaaaaggaacatccgacaatcaaactgggtctggccacctcaataggacgtgtcatttcgcacagacaacacagctcaacttgtacacaactcggacttgtatatgttcgn

SEQ ID NO: 291222 - DNA, 881 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaagtgctatttgtgatgcaaaaacccaaaa

SEQ ID NO: 291223 - DNA, 688 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagaggtagggctttcctcatgccccatccctattggtgtccagttagcccagctgactgcagaggtgtttgcatccccacc

SEQ ID NO: 291224 - DNA, 1972 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgaggttagttgctaagcaaggtggtctttggtcaactgccgcctggaccaaggcaacaggaaccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291225 - DNA, 1631 bp, Homo sapiens
cccgtcgccaacattccttcgttcccctaaatcagcctcttgccccattgctctttgcaggggtagaagaaggaagtgtagcgggccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291226 - DNA, 1939 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaaaaaaaaaaccacacagggcggccgct

SEQ ID NO: 291227 - DNA, 2596 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggtaaggagcttgagggcacagaaggatgattctatacaagaggatgaatcacctctgagggtctagggtcaggctaagagaggctcaggaagtcattcagattctttcataatatgaattagtgactccgaagtctatggtatcatctggggcagccagcaggggacatctgagactccaagtgtgggccagggccatctgaccatctcctagattgctgcacagtgcagactcctgagccccagccatacctaaaaataggctctgaggaatgggacagcacatctgcatttttcattttgcacagcttcccaggagatcattactcccattaaagttggggatctttgctcttgggacacatgaaatgagtcttatttagctgggcacagtaaaatcaaatgaccagacgatgatggtaaaaacagcaaaaggagaaagcaaaagccaggcagggactctccagaggctcttttttaaatcttggggaaatcatacccactgaggaatagaggccagggcagatcaggcctgcgtggattgtgggtcagctagggaagcagaaggaggaagacgctggaatcattgtcaggactgagaatatggtgtgagttgcttttgagggtggccatgtgagcaccttggccagattaatctctttcccccctccatgatggtggcaggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291228 - DNA, 2535 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggtaaggagcttgagggcacagaaggatgattctatacaagaggatgaatcacctctgagggtctagggtcaggctaagagaggctcaggaagtcattcagattctttcataatatgaattagtgactccgaagtctatggtatcatctggggcagccagcaggggacatctgagactccaagtgtgggccagggccatctgaccatctcctagattgctgcacagtgcagactcctgagccccagccatacctaaaaataggctctgaggaatgggacagcacatctgcatttttcattttgcacagcttcccaggagatcattactcccattaaagttggggatctttgctcttgggacacatgaaatgagtcttatttagctgggcacagtaaaatcaaatgaccagacgatgatggtaaaaacagcaaaaggagccactgaggaatagaggccagggcagatcaggcctgcgtggattgtgggtcagctagggaagcagaaggaggaagacgctggaatcattgtcaggactgagaatatggtgtgagttgcttttgagggtggccatgtgagcaccttggccagattaatctctttcccccctccatgatggtggcaggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291229 - DNA, 2779 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggtaaggagcttgagggcacagaaggatgattctatacaagaggatgaatcacctctgagggtctagggtcaggctaagagaggctcaggaagtcattcagattctttcataatatgaattagtgactccgaagtctatggtatcatctggggcagccagcaggggacatctgagactccaagtgtgggccagggccatctgaccatctcctagattgctgcacagtgcagactcctgagccccagccatacctaaaaataggctctgaggaatgggacagcacatctgcatttttcattttgcacagcttcccaggagatcattactcccattaaagttggggatctttgctcttgggacacatgaaatgagtcttatttagctgggcacagtaaaatcaaatgaccagacgatgatggtaaaaacagcaaaaggagaaagcaaaagccaggcagggactctccagaggctcttttttaaatcttggggaaatcatacccactgaggaatagaggccagggcagatcaggcctgcgtggattgtgggtcagctagggaagcagaaggaggaagacgctggaatcattgtcaggactgagaatatggtgtgagttgcttttgagggtggccatgtgagcaccttggccagattaatctctttcccccctccatgatggtggcaggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacaggtatgtgtggaggcccaggagcttagtaatagtatggaggcagaactcatggctgctgagagggggatggtacagttctcagagaagcatggtgaaccggggctcaatgctagggtctgtggaaaagtccctgggcttaaggaatccagaaggagaagataataaagtttttcctactttaagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291230 - DNA, 2007 bp, Homo sapiens
cccgtcgccaacattccttcgttcccctaaatcagcctcttgccccattgctctttgcaggggtagaagaaggaagtgtagcggggtaaggaatgcaccgtcagggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagtcctaggttcctgggagtttctgggatgtgccccaaatgggatgtgtttttcttatatacaagttgttcactttgaaatggaagatgctgctcctgtcagtactattacctgcctctatacttgttgctgagaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291231 - DNA, 2048 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagtcctaggttcctgggagtttctgggatgtgccccaaatgggatgtgtttttcttatatacaagttgttcactttgaaatggaagatgctgctcctgtcagtactattacctgcctctatacttgttgctgagaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291232 - DNA, 2001 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgaggttagttgctaagcaaggtggtctttggtcaactgccgcctggaccaaggcaacaggaaccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggatgctgtatttcaattgctctgtctcaggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291233 - DNA, 1766 bp, Homo sapiens
cccgtcgccaacattccttcgttcccctaaatcagcctcttgccccattgctctttgcaggggtagaagaaggaagtgtagcgggccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagtcctaggttcctgggagtttctgggatgtgccccaaatgggatgtgtttttcttatatacaagttgttcactttgaaatggaagatgctgctcctgtcagtactattacctgcctctatacttgttgctgagaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291234 - DNA, 1850 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgaggttagttgctaagcaaggtggtctttggtcaactgccgcctggaccaaggcaacaggaagtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291235 - DNA, 1671 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291236 - DNA, 1941 bp, Homo sapiens
gtttgatgagtcattatgtccttgaactttattaaaatggactgaatgaaacagattttttagcttgatccatgtccccaactaggaaatttgtccttttttccactagagatggagacagggtagggtagccccttatcagctcttatcaaccttaaggcattacctttggtgagcatccagatctactgaattactgctggtaaatgaacgagaacataaccaaaaatagtttagtactaggttaccttaggaggaggggctgagtcagtgcagagaaacacaggctccatccagcttcttcatggttctttcatgtctgctgcctgtcccactgcaccagcagcttgtcaccttttaagtcagaagcagtgaatgtgctggcagatgaaatccaacccagatcactcagtactttggtgggaaatctgacaagtactagcttatggtaaaaagccctactagtatttgtagagagaagaaaggttgaactcaaatcccagctcaacctgagttctttgacttgtttcctccccaacttcaatcatgtcctccctcagatagaataggtctgtttctagaaaagagaccttaataaagttttctcccttttgatgcttctttgtcttctccccagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291237 - DNA, 1970 bp, Homo sapiens
gtttgatgagtcattatgtccttgaactttattaaaatggactgaatgaaacagattttttagcttgatccatgtccccaactaggaaatttgtccttttttccactagagatggagacagggtagggtagccccttatcagctcttatcaaccttaaggcattacctttggtgagcatccagatctactgaattactgctggtaaatgaacgagaacataaccaaaaatagtttagtactaggttaccttaggaggaggggctgagtcagtgcagagaaacacaggctccatccagcttcttcatggttctttcatgtctgctgcctgtcccactgcaccagcagcttgtcaccttttaagtcagaagcagtgaatgtgctggcagatgaaatccaacccagatcactcagtactttggtgggaaatctgacaagtactagcttatggtaaaaagccctactagtatttgtagagagaagaaaggttgaactcaaatcccagctcaacctgagttctttgacttgtttcctccccaacttcaatcatgtcctccctcagatagaataggtctgtttctagaaaagagaccttaataaagttttctcccttttgatgcttctttgtcttctccccagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggatgctgtatttcaattgctctgtctcaggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291238 - DNA, 1126 bp, Homo sapiens
taggctaggtacgaggccggtgtgaattcggccgaggaaaagatgtacggaatcgcttcccccagcacaccatcatggcagcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291239 - DNA, 2291 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaataaaaaaaaaaaaaaaaaaaaaaaaaaaaaaaaaaaaaaaaaaaaaaaaaaaaaaaaaaaaaaaaaaaaaaaaaaaaaaaacaaaaaaacaaaaaacaaaagagaaacaaaaaaaaaaaagagagggggagggcgccgccacggaagcccccccggcgggggaacccccaggggccacacacaaaggagacgggggcgcacacaaaggaaaagccgagacacaattatgtacacgcgagcaaaggaagagcagaacaactagaataaccaagccagcagacaagcaacaccacacaacaagcggacagaccaacatgacaccgagtggtaggaacgagaccaaatcacgcggttgctaggggggagggcaacaacaat

SEQ ID NO: 291240 - DNA, 2374 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgttgattattggaaaccttaataggaggagttaatgcctgtaagaaaaataaaacctatttcccaactcataatttcccaaactaaaaaataatgggtaattgccatatcccttatggggggttccaatatggccgcttttaaacggggctggaaaaccggggtccacctaaaggctgggaaaaccctttccccttgctaaagccccccatcgctttccaaattgccccttatggcatgaatgtggcctaaattgtcaatcgctatatttgtaacgctttttacaccgggccacgggaactcttatataagaaccccctgacgttggtgtccttaacacaccttattaacgcgctcttcctcgggaaactttaggggtcactcttggtccctcacatttttcggcgccataaatatcctgagcctccctctcttctcggcctcgtgaagaaggaccacttcttcgtcactcaggtgtatccaccttcatctctctaccctctctttctccc

SEQ ID NO: 291241 - DNA, 1668 bp, Homo sapiens
gcagggtatggaggtggcagagatggattagaattcctgggttcttgttggctttgagttgggctgttgggacatcgctgagggcttgggaaatccatgttgtattcatagtgctccttactttgcaggatggaggttgcagctgtcctggggatgtggccaaggcttttggtaaggagcttgagggcacagaaggatgattctatacaagaggatgaatcacctctgagggtctagggtcaggctaagagaggctcaggaagtcattcagattctttcataatatgaattagtgactccgaagtctatggtatcatctggggcagccagcaggggacatctgagactccaagtgtgggccagggccatctgaccatctcctagattgctgcacagtgcagactcctgagccccagccatacctaaaaataggctctgaggaatgggacagcacatctgcatttttcattttgcacagcttcccaggagatcattactcccattaaagttggggatctttgctcttgggacacatgaaatgagtcttatttagctgggcacagtaaaatcaaatgaccagacgatgatggtaaaaacagcaaaaggagaaagcaaaagccaggcagggactctccagaggctcttttttaaatcttggggaaatcatacccactgaggaatagaggccagggcagatcaggcctgcgtggattgtgggtcagctagggaagcagaaggaggaagacgctggaatcattgtcaggactgagaatatggtgtgagttgcttttgagggtggccatgtgagcaccttggccagattaatctctttcccccctccatgatggtggcaggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291242 - DNA, 770 bp, Homo sapiens
ctgtaactcatctgatgagggaataggcggggaatctatcatagcacttcaacttgcagtgcgttctagactatggcacctgaccgatcgtattcagaagcgtccttgcttggaaaagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291243 - DNA, 1437 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacacttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291244 - DNA, 1777 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291245 - DNA, 1617 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttccctggggccacactccgagagggccccgggaaaaaactttgaccctttttttttgggcca

SEQ ID NO: 291246 - DNA, 1286 bp, Homo sapiens
cccgtcgccaacattccttcgttcccctaaatcagcctcttgccccattgctctttgcaggggtagaagaaggaagtgtagcggggtaaggaatgcaccgtcagggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 291247 - DNA, 846 bp, Homo sapiens
cccgtcgccaacattccttcgttcccctaaatcagcctcttgccccattgctctttgcaggggtagaagaaggaagtgtagcggggtaaggaatgcaccgtcagggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatgcagggaatgggggatcctct

SEQ ID NO: 291248 - DNA, 384 bp, Homo sapiens
tcaatttcctgttcatatctgcaggtggatctcacaagatccttttcatttcggaactcaaagcagacatactctggggttcccatcattgctgccaatatggatactgtgggcacctttgagatggccaaggttctctgtaagaggtagggctttcctcatgccccatccctattggtgtccagttagcccagctgactgcagaggtgtttgcatccccacccccatgcccagtcagttctctggcagttagcagtcaggatgctctgatttacggttttttccactactgaagccctttatctgataagttcaaaaggccatctgaattagtgagattcaaagctaagttctgctccgatatttctgatatatgaacagaat

SEQ ID NO: 291249 - DNA, 2555 bp, Homo sapiens
tacaaagtccaagataggtgaggggtttcaaatttctcagtagtgagggagtataagtacggggatgatggagaaatgaagcaggagaggtaaaggatgaggtcggactatgggacttatgcctgggagactccttccttcaacaactctagtgctggtggaggacctgagagatcatctacagaagttcaatcccttattttgttaaaaagagaccggataggtaggggagggaagagaagtgactcaagtttgacaaatccaaacctgggctcccctctcctgcgcctcgcccgctattctttccactcggccagcgtgactccaagacgcgccactacccttctactagccggctgcccggcctctcctccacttaccctggccactggggcgctcctctcatcagtgtcccaggcccagaagccccgcccacgccaggcataggccccgcccctgtatcccaagaccctgcctcctcttgcggtggggggaaagcggcctcttactctaggcctttcggtttgcgcgagcgggcaggaaagcgtgcgtgcggctaagagagtgggcgctctcgcggccgctgacgatggaagaactggagcaaggcctgttgatgcagccatgggcgtggctacagcttgcagagaactccctcttggccaaggtttttatcaccaagcagggctatgccttgttggtttcagatcttcaacaggtgtggcatgaacaggtggacactagtgtggtcagccagcgagccaaggagctgaacaagcggctcactgctcctcctgcagctttcctctgtcatttggataatctccttcgcccattgttgaaggacgctgctcaccctagcgaagctaccttctcctgtgattgtgtggcagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaattccttcttggaacaatttatgatagagaaactgccagaggcatgcagcattggtgatggaaagccctttgtcatgaatctgcaggatctgtatatggcagtcaccacacaagaggtccaagtgggacagaagcatcaaggcgctggagatcctcatacctcaaacagtgcttccctgcaaggaatcgatagccaatgtgtaaaccagccagaacaactggtctcctcagccccaaccctctcagcacctgagaaagagtccacgggtacttcaggccctctgcagagacctcagctgtcaaaggtcaagaggaagaagccaaggggtctcttcagttaatctgttgtggcctcagctgctgaggatggacttggagaatagcttccaagcttcaccttgaaagaagcttacatggcagcaatatttctaaaatagtgatacagtcagaggcctcctgtaagggcgagagaactgaagttgatgttgacaggcccacagggaattggccttccctgttcaagtggaagccagtctctgagaatcccgtgctctcctctcttttggtggaggttctgtaggttcaggtttctaccatggactttaggtatatagggcaagtcagcaagaaagcaccacacactcaggaagccttgtctacctttccctagcgtctctagccagccagccccagatactcctcagagacccacttctctcttttgcatggaataaaaagcactcacagtccctgcttttgggattacttatgctgtggaactcataacccaattcacttccttcactgggtcccaccccattgttgtctctggatgaagtctagccatcagtctggtccttcagattcttcgtaaacttttctgcagttgccagagctaagtctccatttggaaactttgatctcaagaactctcttgatggtgggcacaagacagatagatgattgctgctttcctttgccaaacttggatgcatttttctctttgtttccaaagtataggcaacaggttaaactaccacgtggggtagtttatcaatcctcccgcctcatccttctgcataactgggactaaaggcacacaccaccacacctagctaatttttgtatttttttgtgtgtggagacaaggctttgccatgttgcccaggctggtcttgaactcctggactctagtgatctgcccacctcaacctcccaaagtgctgggattacaggcatgagctaccacgcctatccaatttctggtttatttactttcgatggttaaatgcctccttattcaaatatcctgtatatatactggcgtttctgtcctgatgtcaagtctcgagagaagatgatcaaacaataataaaataattataataagaacaacaataataaata

SEQ ID NO: 291250 - DNA, 1998 bp, Homo sapiens
tgcccggcgtggatggtagggctcgagtgaagatggaagaactggagcaaggcctgttgatgcagccatgggcgtggctacagcttgcagagaactccctcttggccaaggtttttatcaccaagcagggctatgccttgttggtttcagatcttcaacaggtgtggcatgaacaggtggacactagtgtggtcagccagcgagccaaggagctgaacaagcggctcactgctcctcctgcagctttcctctgtcatttggataatctccttcgcccattgttgaaggacgctgctcaccctagcgaagctaccttctcctgtgattgtgtggcagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaattccttcttggaacaatttatgatagagaaactgccagaggcatgcagcattggtgatggaaagccctttgtcatgaatctgcaggatctgtatatggcagtcaccacacaagaggtccaagtgggacagaagcatcaaggcgctggagatcctcatacctcaaacagtgcttccctgcaaggaatcgatagccaatgtgtaaaccagccagaacaactggtctcctcagccccaaccctctcagcacctgagaaagagtccacgggtacttcaggccctctgcagagacctcagctgtcaaaggtcaagaggaagaagccaaggggtctcttcagttaatctgttgtggcctcagctgctgaggatggacttggagaatagcttccaagcttcaccttgaaagaagcttacatggcagcaatatttctaaaatagtgatacagtcagaggcctcctgtaagggcgagagaactgaagttgatgttgacaggcccacagggaattggccttccctgttcaagtggaagccagtctctgagaatcccgtgctctcctctcttttggtggaggttctgtaggttcaggtttctaccatggactttaggtatatagggcaagtcagcaagaaagcaccacacactcaggaagccttgtctacctttccctagcgtctctagccagccagccccagatactcctcagagacccacttctctcttttgcatggaataaaaagcactcacagtccctgcttttgggattacttatgctgtggaactcataacccaattcacttccttcactgggtcccaccccattgttgtctctggatgaagtctagccatcagtctggtccttcagattcttcgtaaacttttctgcagttgccagagctaagtctccatttggaaactttgatctcaagaactctcttgatggtgggcacaagacagatagatgattgctgctttcctttgccaaacttggatgcatttttctctttgtttccaaagtataggcaacaggttaaactaccacgtggggtagtttatcaatcctcccgcctcatccttctgcataactgggactaaaggcacacaccaccacacctagctaatttttgtatttttttgtgtgtggagacaaggctttgccatgttgcccaggctggtcttgaactcctggactctagtgatctgcccacctcaacctcccaaagtgctgggattacaggcatgagctaccacgcctatccaatttctggtttatttactttcgatggttaaatgcctccttattcaaatatcctgtatatatactggcgtttctgtcctgatgtcaagtctcgagagaagatgatcaaacaataataaaataattataataagaacaacaataataaata

SEQ ID NO: 291251 - DNA, 2067 bp, Homo sapiens
ccgtctccgggtgttattttcgttacaggggtttgcgtgaagtggtattgaaatggtcgcttgctgtataaaatgagtgggcgctctcgcggccgctgacgatggaagaactggagcaaggcctgttgatgcagccatgggcgtggctacagcttgcagagaactccctcttggccaaggtttttatcaccaagcagggctatgccttgttggtttcagatcttcaacaggtgtggcatgaacaggtggacactagtgtggtcagccagcgagccaaggagctgaacaagcggctcactgctcctcctgcagctttcctctgtcatttggataatctccttcgcccattgttgaaggacgctgctcaccctagcgaagctaccttctcctgtgattgtgtggcagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaattccttcttggaacaatttatgatagagaaactgccagaggcatgcagcattggtgatggaaagccctttgtcatgaatctgcaggatctgtatatggcagtcaccacacaagaggtccaagtgggacagaagcatcaaggcgctggagatcctcatacctcaaacagtgcttccctgcaaggaatcgatagccaatgtgtaaaccagccagaacaactggtctcctcagccccaaccctctcagcacctgagaaagagtccacgggtacttcaggccctctgcagagacctcagctgtcaaaggtcaagaggaagaagccaaggggtctcttcagttaatctgttgtggcctcagctgctgaggatggacttggagaatagcttccaagcttcaccttgaaagaagcttacatggcagcaatatttctaaaatagtgatacagtcagaggcctcctgtaagggcgagagaactgaagttgatgttgacaggcccacagggaattggccttccctgttcaagtggaagccagtctctgagaatcccgtgctctcctctcttttggtggaggttctgtaggttcaggtttctaccatggactttaggtatatagggcaagtcagcaagaaagcaccacacactcaggaagccttgtctacctttccctagcgtctctagccagccagccccagatactcctcagagacccacttctctcttttgcatggaataaaaagcactcacagtccctgcttttgggattacttatgctgtggaactcataacccaattcacttccttcactgggtcccaccccattgttgtctctggatgaagtctagccatcagtctggtccttcagattcttcgtaaacttttctgcagttgccagagctaagtctccatttggaaactttgatctcaagaactctcttgatggtgggcacaagacagatagatgattgctgctttcctttgccaaacttggatgcatttttctctttgtttccaaagtataggcaacaggttaaactaccacgtggggtagtttatcaatcctcccgcctcatccttctgcataactgggactaaaggcacacaccaccacacctagctaatttttgtatttttttgtgtgtggagacaaggctttgccatgttgcccaggctggtcttgaactcctggactctagtgatctgcccacctcaacctcccaaagtgctgggattacaggcatgagctaccacgcctatccaatttctggtttatttactttcgatggttaaatgcctccttattcaaatatcctgtatatatactggcgtttctgtcctgatgtcaagtctcgagagaagatgatcaaacaataataaaataattataataagaacaacaataataaata

SEQ ID NO: 291252 - DNA, 2501 bp, Homo sapiens
tacaaagtccaagataggtgaggggtttcaaatttctcagtagtgagggagtataagtacggggatgatggagaaatgaagcaggagaggtaaaggatgaggtcggactatgggacttatgcctgggagactccttccttcaacaactctagtgctggtggaggacctgagagatcatctacagaagttcaatcccttattttgttaaaaagagaccggataggtaggggagggaagagaagtgactcaagtttgacaaatccaaacctgggctcccctctcctgcgcctcgcccgctattctttccactcggccagcgtgactccaagacgcgccactacccttctactagccggctgcccggcctctcctccacttaccctggccactggggcgctcctctcatcagtgtcccaggcccagaagccccgcccacgccaggcataggccccgcccctgtatcccaagaccctgcctcctcttgcggtggggggaaagcggcctcttactctaggcctttcggtttgcgcgagcgggcaggaaagcgtgcgtgcggctaagagagtgggcgctctcgcggccgctgacgatggaagaactggagcaaggcctgttgatgcagccatgggcgtggctacagcttgcagagaactccctcttggccaaggtttttatcaccaagcagggctatgccttgttggtttcagatcttcaacaggtgtggcatgaacaggtggacactagtgtggtcagccagcgagccaaggagctgaacaagcggctcactgctcctcctgcagctttcctctgtcatttggataatctccttcgcccattgttgaaggacgctgctcaccctagcgaagctaccttctcctgtgattgtgtggcagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagttggtgatggaaagccctttgtcatgaatctgcaggatctgtatatggcagtcaccacacaagaggtccaagtgggacagaagcatcaaggcgctggagatcctcatacctcaaacagtgcttccctgcaaggaatcgatagccaatgtgtaaaccagccagaacaactggtctcctcagccccaaccctctcagcacctgagaaagagtccacgggtacttcaggccctctgcagagacctcagctgtcaaaggtcaagaggaagaagccaaggggtctcttcagttaatctgttgtggcctcagctgctgaggatggacttggagaatagcttccaagcttcaccttgaaagaagcttacatggcagcaatatttctaaaatagtgatacagtcagaggcctcctgtaagggcgagagaactgaagttgatgttgacaggcccacagggaattggccttccctgttcaagtggaagccagtctctgagaatcccgtgctctcctctcttttggtggaggttctgtaggttcaggtttctaccatggactttaggtatatagggcaagtcagcaagaaagcaccacacactcaggaagccttgtctacctttccctagcgtctctagccagccagccccagatactcctcagagacccacttctctcttttgcatggaataaaaagcactcacagtccctgcttttgggattacttatgctgtggaactcataacccaattcacttccttcactgggtcccaccccattgttgtctctggatgaagtctagccatcagtctggtccttcagattcttcgtaaacttttctgcagttgccagagctaagtctccatttggaaactttgatctcaagaactctcttgatggtgggcacaagacagatagatgattgctgctttcctttgccaaacttggatgcatttttctctttgtttccaaagtataggcaacaggttaaactaccacgtggggtagtttatcaatcctcccgcctcatccttctgcataactgggactaaaggcacacaccaccacacctagctaatttttgtatttttttgtgtgtggagacaaggctttgccatgttgcccaggctggtcttgaactcctggactctagtgatctgcccacctcaacctcccaaagtgctgggattacaggcatgagctaccacgcctatccaatttctggtttatttactttcgatggttaaatgcctccttattcaaatatcctgtatatatactggcgtttctgtcctgatgtcaagtctcgagagaagatgatcaaacaataataaaataattataataagaacaacaataataaata

SEQ ID NO: 291253 - DNA, 1610 bp, Homo sapiens
  misc_feature (1603)..(1603): n is a, c, g, or t
tacaaagtccaagataggtgaggggtttcaaatttctcagtagtgagggagtataagtacggggatgatggagaaatgaagcaggagaggtaaaggatgaggtcggactatgggacttatgcctgggagactccttccttcaacaactctagtgctggtggaggacctgagagatcatctacagaagttcaatcccttattttgttaaaaagagaccggataggtaggggagggaagagaagtgactcaagtttgacaaatccaaacctgggctcccctctcctgcgcctcgcccgctattctttccactcggccagcgtgactccaagacgcgccactacccttctactagccggctgcccggcctctcctccacttaccctggccactggggcgctcctctcatcagtgtcccaggcccagaagccccgcccacgccaggcataggccccgcccctgtatcccaagaccctgcctcctcttgcggtggggggaaagcggcctcttactctaggcctttcggtttgcgcgagcgggcaggaaagcgtgcgtgcggctaagagagtgggcgctctcgcggccgctgacgatggaagaactggagcaaggcctgttgatgcagccatgggcgtggctacagcttgcagagaactccctcttggccaaggtttttatcaccaagcagggctatgccttgttggtttcagatcttcaacaggtgtggcatgaacaggtggacactagtgtggtcagccagcgagccaaggagctgaacaagcggctcactgctcctcctgcagctttcctctgtcatttggataatctccttcgcccattgttgaaggacgctgctcaccctagcgaagctaccttctcctgtgattgtgtggcagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaattccttcttggaacaatttatgatagagaaactgccagaggcatgcagcattggtgatggaaagccctttgtcatgaatctgcaggatctgtatatggcagtcaccacacaagaggtccaagtgggacagaagcatcaaggcgctggagatcctcatacctcaaacagtgcttccctgcaaggaatcgatagccaatgtgtaaaccagccagaacaactggtctcctcagccccaaccctctcagcacctgagaaagagtccacgggtacttcaggccctctgcagagacctcagctgtcaaaggtcaagaggaagaagccaaggggtctcttcagttaatctgttgtggcctcagctgctgaggatggacttggagaatagcttccaagcttcaccttgaaagaagcttacatggcagcaatatttctgttgacaggccccacaggaattggncttcctt

SEQ ID NO: 291254 - DNA, 552 bp, Homo sapiens
aggcatttatcactatcttctcttgatctttctgatttcaggagatcctcatacctcaaacagtgcttccctgcaaggaatcgatagccaatgtgtaaaccagccagaacaactggtctcctcagccccaaccctctcagcacctgagaaagagtccacggtgagtcatgagcagcttcctggatggtgttctgagagttggcacctatagcccccaagccagtggtccctggaattgctgcttcattggcactgcctcaaaaatattgagggatatttgtgaccaggctccaaattgtaggtgtctagatggagagtcatggtcttgcacatcttcccttggtgtcccttctctgtaggtcttgtacgaatgatgtgccttgactcctctttcaccttatcccacttccggtgatggccagtgatgaccagtgatagtcagcgaggctattccttgggggagaagggaatctacatctcctgcttagggtcttatatcgcatttgctgtctgacatagacttcaaaatacctatgtcagacacttcctgaa

SEQ ID NO: 291255 - DNA, 739 bp, Homo sapiens
tattttcaatgtaccttttcccaaatgtcctaaattaaaagtggatgctgatcaagttcactggtcaacttcaattcttcctttctcttttctttacagatgcagcctttttgaaatttattcttggccaaaagaggaagatagttcaaggattctatcttgcttttggggggcaatggagaaaccctgaaaacacttaaggaaaacctgaggccttctataagaaaataaactccctgaaaggggaggcagggccaaggaatttacttatttttataaatctctttcctgggtggatatggtaatggatgtgtttcttgaattgtggtaaatgtacctcataaaatggatggactggggctatattctcaggcttcctgggctctgttggcattgggcaagcacgtaatgcctggtttgaggctagaagccaaagccacaaccttcttgcagtaccaactgagccatagggagattaatgcagaacaaggtcgttagtctcattgtttatccagttactagccgcatagattttgtgtaaatttcagctacagtggttgcagcctgcctttgatgtgtgtaatctgtacattttagtgctccaggaaagtacctgattgacaagatctacatccaatgcccagaaaacacatcctacacaggcacagtgaagcgtggagttgaagaattttccagtgagttccatcaaagtaaataaaccaacctagagcatcagaat

SEQ ID NO: 291256 - DNA, 1122 bp, Homo sapiens
acaaggacgagagaaaagcacggtgcccctcgagtcctctccgccccctcggtcctaacccccgcccaggctccaggtcttcccctttgtgtggcctggactctctcccagctacgactttggtgggatccaaaaggaaggaggtggcggggcctacggaagaggatacccaggagccagggagaagggctagaaaacgaataatgtgactccagaggcggaaccccgaccccctctatttcccaccccggcttcacccggagacgaaagctgtgggcatcttcagtttaacggacttcgcggaaaaggagagaaggggggcgagggaaatggcagtttgtgtcccaggggttcttccccttcttcttgccgcctcctaaagacaaacaaactcaaccccccaccctccggggtatcagggaactcgtgggaccgtgaaaaagtcgttcccaaatccggccgcctgcggacgtcggacttccgcggggccggcgcccgttggcgtctgtagctcggcgcagccacgcggggctccagcgagcggggtccgccacccctcgcgccctcctgcggctttcccagcgctgggccagtgcaggccgagccctgcgtccctgcctcgctgggtgggggtccggggcgcggctgtccacagggccgcctcctcctgcggcccgcggggaaggggcgcatcccaccccgctctgcaggccgcccttctgccagctgggaggcgagggcacacgtcctaaggctgcccaagggggagaggaatcgcgccggtaggagagcgcacgggaaccaggaacgcaaggcgggcacaggggagccgaaggagccagacagggcccggccacgcgccctcctcgctcggctgcgctccgtgacgggaacccaggctcccacgcacggggaatgcctagaacggagctagaatggaggtgggagctggagtcattttgcgggccacaggactgctcatttcgtgggcaggacgtgacattcttgtccctcctttctgaaaaacttttctcaggcgcctgaacttggcatggggaccggcctcgaaaagccggcgggtagcacggccgcggtatccaacccttcgccctccttcccacc

SEQ ID NO: 291257 - DNA, 189 bp, Homo sapiens
  misc_feature (75)..(75): n is a, c, g, or t
gatgggtggggtgtcgaggtgagtgggggaaaccaagagaggcttatagctaacgcaagtaccttgtgtagaagnatctacatccaatgcccagaaaacacatcctacacaggcacagtgaagcgtggagttgaagaattttccagtgagttccatcaaagtaaataaaccaacctagagcatcagaat

SEQ ID NO: 291258 - DNA, 1682 bp, Homo sapiens
acaaggacgagagaaaagcacggtgcccctcgagtcctctccgccccctcggtcctaacccccgcccaggctccaggtcttcccctttgtgtggcctggactctctcccagctacgactttggtgggatccaaaaggaaggaggtggcggggcctacggaagaggatacccaggagccagggagaagggctagaaaacgaataatgtgactccagaggcggaaccccgaccccctctatttcccaccccggcttcacccggagacgaaagctgtgggcatcttcagtttaacggacttcgcggaaaaggagagaaggggggcgagggaaatggcagtttgtgtcccaggggttcttccccttcttcttgccgcctcctaaagacaaacaaactcaaccccccaccctccggggtatcagggaactcgtgggaccgtgaaaaagtcgttcccaaatccggccgcctgcggacgtcggacttccgcggggccggcgcccgttggcgtctgtagctcggcgcagccacgcggggctccagcgagcggggtccgccacccctcgcgccctcctgcggctttcccagcgctgggccagtgcaggccgagccctgcgtccctgcctcgctgggtgggggtccggggcgcggctgtccacagggccgcctcctcctgcggcccgcggggaaggggcgcatcccaccccgctctgcaggccgcccttctgccagctgggaggcgagggcacacgtcctaaggctgcccaagggggagaggaatcgcgccggtaggagagcgcacgggaaccaggaacgcaaggcgggcacaggggagccgaaggagccagacagggcccggccacgcgccctcctcgctcggctgcgctccgtgacgggaacccaggctcccacgcacggggaatgcctagaacggagctagaatggaggcccctttgtgtgactaaatttggcaagaatatggatctgagccagtctttccacgtgtgctcccagctcccagctgagaaggccaagggttctcttccggatgcagcctttttgaaatttattcttggccaaaagaggaagatagttcaaggattctatcttgcttttggggggcaatggagaaaccctgaaaacacttaaggaaaacctgaggccttctataagaaaataaactccctgaaaggggaggcagggccaaggaatttacttatttttataaatctctttcctgggtggatatggtaatggatgtgtttcttgaattgtggtaaatgtacctcataaaatggatggactggggctatattctcaggcttcctgggctctgttggcattgggcaagcacgtaatgcctggtttgaggctagaagccaaagccacaaccttcttgcagtaccaactgagccatagggagattaatgcagaacaaggtcgttagtctcattgtttatccagttactagccgcatagattttgtgtaaatttcagctacagtggttgcagcctgcctttgatgtgtgtaatctgtacattttagtgctccaggaaagtacctgattgacaagatctacatccaatgcccagaaaacacatcctacacaggcacagtgaagcgtggagttgaagaattttccagtgagttccatcaaagtaaataaaccaacctagagcatcagaat

SEQ ID NO: 291259 - DNA, 1386 bp, Homo sapiens
acaaggacgagagaaaagcacggtgcccctcgagtcctctccgccccctcggtcctaacccccgcccaggctccaggtcttcccctttgtgtggcctggactctctcccagctacgactttggtgggatccaaaaggaaggaggtggcggggcctacggaagaggatacccaggagccagggagaagggctagaaaacgaataatgtgactccagaggcggaaccccgaccccctctatttcccaccccggcttcacccggagacgaaagctgtgggcatcttcagtttaacggacttcgcggaaaaggagagaaggggggcgagggaaatggcagtttgtgtcccaggggttcttccccttcttcttgccgcctcctaaagacaaacaaactcaaccccccaccctccggggtatcagggaactcgtgggaccgtgaaaaagtcgttcccaaatccggccgcctgcggacgtcggacttccgcggggccggcgcccgttggcgtctgtagctcggcgcagccacgcggggctccagcgagcggggtccgccacccctcgcgccctcctgcggctttcccagcgctgggccagtgcaggccgagccctgcgtccctgcctcgctgggtgggggtccggggcgcggctgtccacagggccgcctcctcctgcggcccgcggggaaggggcgcatcccaccccgctctgcaggccgcccttctgccagctgggaggcgagggcacacgtcctaaggctgcccaagggggagaggaatcgcgccggtaggagagcgcacgggaaccaggaacgcaaggcgggcacaggggagccgaaggagccagacagggcccggccacgcgccctcctcgctcggctgcgctccgtgacgggaacccaggctcccacgcacggggaatgcctagaacggagctagaatggaggcccctttgtgtgactaaatttggcaagaatatggatctgagccagtctttccacgtgtgctcccagctcccagctgagaaggccaagggttctcttccggatgcagcctttttgaaatttattcttggccaaaagaggaagatagttcaaggattctatcttgcttttggggggcaatggagaaaccctgaaaacacttaaggaaaacctgaggccttctataagaaaataaactccctgaaaggggaggcagggccaaggaatttacttatttttataaatctctttcctgggtggatatgtgctccaggaaagtacctgattgacaagatctacatccaatgcccagaaaacacatcctacacaggcacagtgaagcgtggagttgaagaattttccagtgagttccatcaaagtaaataaaccaacctagagcatcagaat

SEQ ID NO: 291260 - DNA, 1971 bp, Homo sapiens
acaaggacgagagaaaagcacggtgcccctcgagtcctctccgccccctcggtcctaacccccgcccaggctccaggtcttcccctttgtgtggcctggactctctcccagctacgactttggtgggatccaaaaggaaggaggtggcggggcctacggaagaggatacccaggagccagggagaagggctagaaaacgaataatgtgactccagaggcggaaccccgaccccctctatttcccaccccggcttcacccggagacgaaagctgtgggcatcttcagtttaacggacttcgcggaaaaggagagaaggggggcgagggaaatggcagtttgtgtcccaggggttcttccccttcttcttgccgcctcctaaagacaaacaaactcaaccccccaccctccggggtatcagggaactcgtgggaccgtgaaaaagtcgttcccaaatccggccgcctgcggacgtcggacttccgcggggccggcgcccgttggcgtctgtagctcggcgcagccacgcggggctccagcgagcggggtccgccacccctcgcgccctcctgcggctttcccagcgctgggccagtgcaggccgagccctgcgtccctgcctcgctgggtgggggtccggggcgcggctgtccacagggccgcctcctcctgcggcccgcggggaaggggcgcatcccaccccgctctgcaggccgcccttctgccagctgggaggcgagggcacacgtcctaaggctgcccaagggggagaggaatcgcgccggtaggagagcgcacgggaaccaggaacgcaaggcgggcacaggggagccgaaggagccagacagggcccggccacgcgccctcctcgctcggctgcgctccgtgacgggaacccaggctcccacgcacggggaatgcctagaacggagctagaatggaggcccctttgtgtgactaaatttggcaagaatatggatctgagccagtctttccacgtgtgctcccagctcccagctgagaaggccaagggttctcttccggatgcagcctttttgaaatttattcttggccaaaagaggaagatagttcaaggattctatcttgcttttggggggcaatggagaaaccctgaaaacacttaaggaaaacctgaggccttctataagaaaataaactccctgaaaggggaggcagggccaaggaatttacttatttttataaatctctttcctgggtggatatggtaatggatgtgtttcttgaattgtggtaaatgtacctcataaaatggatggactggggctatattctcaggcttcctgggctctgttggcattgggcaagcacgtaatgcctggtttgaggctagaagccaaagccacaaccttcttgcagtaccaactgagccatagggagattaatgcagaacaaggtcgttagtctcattgtttatccagttactagccgcatagattttgtgtaaatttcagctacagtggttgcagcctgcctttgatgtgtgtaatctgtacattttagtgctccaggaaagtacctgattgacaagatctacatccaatgcccagaaaacacatcctacacaggcacagtgaagcgtggagttgaagaattttccagaaaaccagtttggctattaagggaacctgtcgacacagagcagagcaagataaggccaggtttcagaaagaatagctgtttaccatcaaagcaactgggttccacacagacatggtatattatacacaaagacgaaggatatgggtccactctccgtcaaggaatgttataaatccacgtggtgtccctgggtgtcaggcttggccagaacatctgtggctggagaagccaatgtggctcaggagctccctgctggctgcacatctgaacggcttcaggagtacaagtttccccatcaaaggtttggaataaattacactaaaaaattggct

SEQ ID NO: 291261 - DNA, 1225 bp, Homo sapiens
acaaggacgagagaaaagcacggtgcccctcgagtcctctccgccccctcggtcctaacccccgcccaggctccaggtcttcccctttgtgtggcctggactctctcccagctacgactttggtgggatccaaaaggaaggaggtggcggggcctacggaagaggatacccaggagccagggagaagggctagaaaacgaataatgtgactccagaggcggaaccccgaccccctctatttcccaccccggcttcacccggagacgaaagctgtgggcatcttcagtttaacggacttcgcggaaaaggagagaaggggggcgagggaaatggcagtttgtgtcccaggggttcttccccttcttcttgccgcctcctaaagacaaacaaactcaaccccccaccctccggggtatcagggaactcgtgggaccgtgaaaaagtcgttcccaaatccggccgcctgcggacgtcggacttccgcggggccggcgcccgttggcgtctgtagctcggcgcagccacgcggggctccagcgagcggggtccgccacccctcgcgccctcctgcggctttcccagcgctgggccagtgcaggccgagccctgcgtccctgcctcgctgggtgggggtccggggcgcggctgtccacagggccgcctcctcctgcggcccgcggggaaggggcgcatcccaccccgctctgcaggccgcccttctgccagctgggaggcgagggcacacgtcctaaggctgcccaagggggagaggaatcgcgccggtaggagagcgcacgggaaccaggaacgcaaggcgggcacaggggagccgaaggagccagacagggcccggccacgcgccctcctcgctcggctgcgctccgtgacgggaacccaggctcccacgcacggggaatgcctagaacggagctagaatggaggcccctttgtgtgactaaatttggcaagaatatggatctgagccagtctttccacgtgtgctcccagctcccagctgagaaggccaagggttctcttccgggtaaggagacagggagaaagatcaaagagtttggggagctggatctgaaatgtgaattgaaaataaaaatcaagcctggacacattccagtttctaaagcaaaaccaaccctcagcagaggccggctctctatatagctctctttctttctctctctgctccctttgactcttttctgtgacc

SEQ ID NO: 291262 - DNA, 500 bp, Homo sapiens
aagctaggctggtacggtcccggtcttagatcaggccgcctcctcctgcggcccgcggggaaggggcgcatcccaccccgctctgcaggccgcccttctgccagctgggaggcgagggcacacgtcctaaggctgcccaagggggagaggaatcgcgccggtaggagagcgcacgggaaccaggaacgcaaggcgggcacaggggagccgaaggagccagacagggcccggccacgcgccctcctcgctcggctgcgctccgtgacgggaacccaggctcccacgcacggggaatgcctagaacggagctagaatggaggtgggagctggagtcattttgcgggccacaggactgctcatttcgtgggcaggacgtgacattcttgtccctcctttctgaaaaacttttctcaggcgcctgaacttggcatggggaccggcctcgaaaagccggcgggtagcacggccgcggtatccaacccttcgccctccttcccacc

SEQ ID NO: 291263 - DNA, 1052 bp, Homo sapiens
gcctctcggaactggggcagcggcccgctcacctcgtgtccgttgctggccgggatgatttcagactcgttcaccaaggaagacttgatgtcagctaaatcgccttcctcttcgggatgactgatctcggcgaagatcttttccttctgaggatcgccctcgtccttgaaggggatcatctcgtccgtggcgcagagttccgggtcccccccgccgccgccacctcctccggagagttggggcatcccggcggctctgtaatctccgctccgctgtgggagcacccgcgcaacagcaggaaagacagaggggcccctttgtgtgactaaatttggcaagaatatggatctgagccagtctttccacgtgtgctcccagctcccagctgagaaggccaagggttctcttccggatgcagcctttttgaaatttattcttggccaaaagaggaagatagttcaaggattctatcttgcttttggggggcaatggagaaaccctgaaaacacttaaggaaaacctgaggccttctataagaaaataaactccctgaaaggggaggcagggccaaggaatttacttatttttataaatctctttcctgggtggatatggtaatggatgtgtttcttgaattgtggtaaatgtacctcataaaatggatggactggggctatattctcaggcttcctgggctctgttggcattgggcaagcacgtaatgcctggtttgaggctagaagccaaagccacaaccttcttgcagtaccaactgagccatagggagattaatgcagaacaaggtcgttagtctcattgtttatccagttactagccgcatagattttgtgtaaatttcagctacagtggttgcagcctgcctttgatgtgtgtaatctgtacattttagtgctccaggaaagtacctgattgacaagatctacatccaatgcccagaaaacacatcctacacaggcacagtgaagcgtggagttgaagaattttccagtgagttccatcaaagtaaataaaccaacctagagcatcagaat

SEQ ID NO: 291264 - DNA, 716 bp, Homo sapiens
agtgtacggtcggaatagggatcgcgctgggccagtgcaggccgagccctgcgtccctgcctcgctgggtgggggtccggggcgcggctgtccacagggccgcctcctcctgcggcccgcggggaaggggcgcatcccaccccgctctgcaggccgcccttctgccagctgggaggcgagggcacacgtcctaaggctgcccaagggggagaggaatcgcgccggtaggagagcgcacgggaaccaggaacgcaaggcgggcacaggggagccgaaggagccagacagggcccggccacgcgccctcctcgctcggctgcgctccgtgacgggaacccaggctcccacgcacggggaatgcctagaacggagctagaatggaggaaaaccagtttggctattaagggaacctgtcgacacagagcagagcaagataaggccaggtttcagaaagaatagctgtttaccatcaaagcaactgggttccacacagacatggtatattatacacaaagacgaaggatatgggtccactctccgtcaaggaatgttataaatccacgtggtgtccctgggtgtcaggcttggccagaacatctgtggctggagaagccaatgtggctcaggagctccctgctggctgcacatctgaacggcttcaggagtacaagtttccccatcaaaggtttggaataaattacactaaaaaattggct

SEQ ID NO: 291265 - DNA, 473 bp, Homo sapiens
cctgcctaagcccctctggaggctgggatgcagaggaggaaggaggaggtgcagaagcaaagccttgaaaatactgtacttctggtgctgacggccccattcccctgaggcctactggagctcaccatagttactatttagttgtgtgccacgagtgaggtcggcctgcaggctcactgcgcctggggagacacaggagggaccccccaacattagccaaagtctcagctgagtctcctcactgatgtgacttgtggatttggaagcgaagactgctgtgtcctcagagattgaaaagcaaccaagtcaatactgagaagaagattttgctacttatttctctgactaatcattgttattctctgcttaacttgtaaaaatttttacttattttgacataatttcagacttgcattaaaatgttgcaaaattagtgtaaagaattctcacataaacttcgcctagacttccta

SEQ ID NO: 291266 - DNA, 340 bp, Homo sapiens
ttcagacagggttggaattccagctcaaccacagatcagcaatgtgaaacctttaggaagttactgcatttctttgtgccttgaatactccatctgtagaacgggtaatcgtgtaaggaagaaaaaggggttacaaagaggttttctacttgctgggctaaaggcccctggtggcttctggtagctataaaacccccgaacgcttaggtaaggattagagaagaaacccagagtggctgtgagtcaagaaaagacatcagataacagcaattattttaccattatgtgacacgtaatactaatgttcctacctgaagataaagagcacaattttaaaatc

SEQ ID NO: 291267 - DNA, 1722 bp, Homo sapiens
tttttttttttagaggtatttttgtttgttcccatttcatgtgctattcatttgagctgaaatattagttttgtttgtacacagaaaacatttgaacacttttatagccagaaagaatgagcccacaatgttggcaggttgacaccacaaaaggaaaggataaggtttctaaacgaaagtcaagaacacagatgaaattgttaccttaaataatcatctcaatgggttctacaaattcttaagacagctttcaaatttactgcaattttaagtgtgtatataatgcctcttttaaaagaagggatgggaatcattatgatattagctcagtcaagggcaaaggaagacttactaaatgacctctatgtcaaaacctttcacagttatcatcacatttagacatcacaactttgcaatccatttgtagaagaaaaacgaaaggctcagagaggtcaagtgaccttcccaaggtcaaaaacccaattggcagctgacaaaggctcaaaatgaagctgatctgacttcagtctccttgcacttccccatgccatgctacgtgtctaacaatctggaagtatcacagaggagcaaaaatagctgaattcagctgcagtgaacagtatcaggaaagaagagaaaaaaactgtccgggaccacatattatacctggccttaaatctatccaagctaaccagattttggacaacagaccaatgaaggagccaatgaatcagtacatatatcacaagaaggctgctacacagactgaatgtttgtgcccccacccacaaaaaaacatgtattaaaatactaacccctaatgtgacggtgttagaagtgagacctttgggtggtgatgatgttgtgagggcaaagcactcatgaatgagattagtgacctcataaaagcagccccagagagctgccttgcctttcctgccaggtgagtacacagtgagaagatggccaactataagccaggaaacaggcctccatcaacaaggaatctgccggcaacttgatcttggacttcccagcctccaggattgtgagaaatcaattatgttgtttataaaaccacacattctatgatattttataatggcagcctaaacgaactaagacagggttgtgtcattttctaccaaattcacagcaacatcagcaatggcttttcaaatttcagttatttgagcttcctcaacatttagggtggagatacactacattttggttaacaacaaacaaacagaacccatccccctcaccccaaaaataattttatttaggaaattaacctccctaaaaatctggcatgttttggaggcaaagaagtatgaataaagaaaacacacaaacgaacaacaaggaaactttccatgtagccaaagttctcacaacacccatctctgaaatgcactactttatctcagggagacaagtaaggtaaactatatcaaggccatagggaagctccaaaaaaaatcatgaagtacaaagttcaaacaacattacaggttttgaagggctttgacaacgttccaccttctacctatggagacttgtagctaacacaaatgtcccattatactgcttgatgttttccagcagctaaaacctgtgaaacatgttaaaaagaaaaaaattaagtggggtggggatcttagagtagatccaattcagcagtaccacagaaactaaagtttaaataaggagactctc

SEQ ID NO: 291268 - DNA, 1496 bp, Homo sapiens
tttttttttttagaggtatttttgtttgttcccatttcatgtgctattcatttgagctgaaatattagttttgtttgtacacagaaaacatttgaacacttttatagccagaaagaatgagcccacaatgttggcaggttgacaccacaaaaggaaaggataaggtttctaaacgaaagtcaagaacacagatgaaattgttaccttaaataatcatctcaatgggttctacaaattcttaagacagctttcaaatttactgcaattttaagtgtgtatataatgcctcttttaaaagaagggatgggaatcattatgatattagctcagtcaagggcaaaggaagacttactaaatgacctctatgtcaaaacctttcacagttatcatcacatttagacatcacaactttgcaatccatttgtagaagaaaaacgaaaggctcagagaggtcaagtgaccttcccaaggtcaaaaacccaattggcagctgacaaaggctcaaaatgaagctgatctgacttcagtctccttgcacttccccatgccatgctacgtgtctaacaatctggaagtatcacagaggagcaaaaatagctgaattcagctgcagtgaacagtatcaggaaagaagagaaaaaaactgtccgggaccacatattatacctggccttaaatctatccaagctaaccagattttggacaacagaccaatgaaggagccaatgaatcagtacatatatcacaagaaggctgctacacagactgaatgtttgtgcccccacccacaaaaaaacatgtattaaaatactaacccctaatgtgacggtgttagaagtgagacctttgggtggtgatgatgttgtgagggcaaagcactcatgaatgagattagtgacctcataaaagcagccccagagagctgccttgcctttcctgccaggtgagtacacagtgagaagatggccaactataagccaggaaacaggcctccatcaacaaggaatctgccggcaacttgatcttggacttcccagcctccaggattgaagaaaaatatgttgcaaacatggaggaaagatgatggcctccttcaacagaactatgagttgtccaagatttcacaaagttcttcaagcatggcatttgatgatgagccctaagatgacttgagcctcacgtcaactctctttgctacaaggtctgcaagcaggtgaaagagcaagccgcaaaaagagctgcaaaactggaaaacagcacaagggtggcccaagactgtcgtttccaaaagtgttatgtagaaccgccgcagcagcatatggccaagagcgaagcctgcctgagagcaaaccgccaagtcaaggatagcagagctcagagagaaaaaactaaagtccttaaggacatcaatgagttcctcatcataccacatattgtctagatcccaaccacttctggattctcaatgttgtgaaataataatcccctgattattt

SEQ ID NO: 291269 - DNA, 496 bp, Homo sapiens
gcctgtattacagataggtatggttgttaaagaaacttttgttgtactgtttctgttgtttacagagtaatgtaatttttaaacttatattccagagagatataaaatagcctcctccatcgtcagccaatgatatcactgttgagctgttttcaataaaagttcatgctgtacttcctgcctcacaggtcatgtctggttccgtttttggatcctctccactgtattcaatccctttggttctcaaggtgactactgactgatcaggggcttgaaaaaagggagacaatattgatttttaatttgtttttgtttttctctaatcatagcagctgaaatttttcatccaagctgtggcctctttgactactacattgcagttctcaaacttttaactttagacttctctggatagtttctaagatataaattaaattcagtgtcaatgaaaacaaacttacaaaacaggccttcttggcaacacccctctccccag

SEQ ID NO: 291270 - DNA, 339 bp, Homo sapiens
ccaagctgtggcctctttgactactacattgcagttctcaaacttttaactttagacttctctggatagtttctaagatataaattaaattcagtgtcaatgaaaacaaacttacaaaacaggccttcttggcaacacccctctccccagatatagaggtgctaatggattctcatcctctcctaggagccctaagatgacttgagcctcacgtcaactctctttgctacagttaagtcaattctcttttcttagttatctaagtgccagccaaatactgcatcttagcatttttcattccaaaccactttgtggatgaagagggccacactgaaatgg

SEQ ID NO: 291271 - DNA, 853 bp, Homo sapiens
gagagccacttccggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggtactgtgatcctagaattgtccaaggaaaaaactaacgagcggctcctagaccggcaggcggcggccttcaccgcttcagtgcaacacgtggaggcggagctgtcagctcagatccgctacctcacccaggtggccacagggcagccccatgagggctccagctactcttcgaggaaggactgtcagatggctctgaagcgagtggactatgcccgcctcaagctcagtgatgtggctcgaacctgtgagcagatgctggagaactaggccagggagatggacccagagctgagagggagaccatcacctgtgccatgggacagaacctgggaacatgtagggtggggagtatgagcaccaacataccctgctggtcaaagtaccctaggacaaaggggcaaatggtgggcatggaaaaactgaagcccgagcctgcccacagctatgccttggcctctccagcagggtgctcctgctctgcactccagaaacaccctgacaggctcagagaggagatggaaactgacatacccaacccacttcctcaaacacttcatgctgctgccccagccttcccgcagacttggcctaatgaaaatacatacttcttcattcggagagacaaaacaagaactagagttttaatgataataaaagcaataataataaaagcaataacaataaaaacaaaaaaaga

SEQ ID NO: 291272 - DNA, 799 bp, Homo sapiens
gagagccacttccggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggtactgtgatcctagaattgtccaaggaaaaaactaacgagcggctcctagaccggcaggcggcggccttcaccgcttcagtgcaacacgtggaggcggagctgtcagctcagatccgctacctcacccaggtggccacagggcagccccatgagggctccagctactcttcgaggaaggactgtcagatggctctgaagcgagtggactatgcccgcctcaagctcagtgatgtggctcgaacctgtgagcagatgctggagaactaggccagggagatggacccagagctgagagggagaccatcacctgtgccatgggacagaacctgggaacatgtagggtggggagtatgagcaccaacataccctgctggtcaaagtaccctaggacaaaggggcaaatggtgggcatggactcctgctctgcactccagaaacaccctgacaggctcagagaggagatggaaactgacatacccaacccacttcctcaaacacttcatgctgctgccccagccttcccgcagacttggcctaatgaaaatacatacttcttcattcggagagacaaaacaagaactagagttttaatgataataaaagcaataataataaaagcaataacaataaaaacaaaaaaaga

SEQ ID NO: 291273 - DNA, 1131 bp, Homo sapiens
gagagccacttccggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggttcgggatgcgacaacctggacagcggggagcgaaagcgtgaccgggctgcactggcagcctgacctgggacttggagcagggttggggagggaatcctacgtgcgtgcgcagcgaaagggcgggactgagaggggctggcctagggagaggctacactggcagtctccgtgtgtccccgccctctctccgccctggcaggtactgtgatcctagaattgtccaaggaaaaaactaacgagcggctcctagaccggcaggcggcggccttcaccgcttcagtgcaacacgtggaggcggagctgtcagctcagatccgctacctcacccaggtcggtgtgtctggggggttctgcgagcgaaccccagctctgggtcaaagcctcaggcttgggtgatccagggtggagcattaactgggcaggaccagacctccccagccggccatccagagcgggtttcttcctctaaaaggaaagaatgggccgggcgcagtggcttgacagagttcgagaccagcctggccaacacggtgaaacctcgtctctactaaaaatataaaaattaggccaggctcggtggctcactcctgtaatcccagcactttgggaggctgaggcgggtggatcatctgaggtcaggagttcgagaccagcctggccaacatggtgaaactccgtctctactaaaaatacaaaaattagctgggctggtagcgggcacctgtaatcccagctacttggaagggtgaggcaggagaatcgcttgaacccaggaggtggaggttgcagtgagccaagattgcagcactgcactccagcctgggtgacaaagcaagactgtctcaaaaaaaaaaaaagccgggcttggtggtgagtaccggtaaccccagctacttggaaggctgaggcaggagaatcgcttgaacccaggaggcggaggttgttgtacttagccgagatcatgccattgcactc

SEQ ID NO: 291274 - DNA, 985 bp, Homo sapiens
ctcactgggtaacatcacatgtgcctagcagaagatgtgtaaataatgctagaactacagaactttgtcactggaaacttggcctgacctccaggccacgaggtcccaaatccttatatcctgagaagagggacaggattgagaaggttctgaaatcgtcgcagggaccactaccattactaatttttacggtgtgccagatactctgcattactttatctaatcctcaacaactctaggaagtagttattgtcacccccattttacagacaagattaacataagttaaatgatttatttacccagctaccagatggcctaacaaattcaaactcagggaagaaatgagacgagacctgatgcctggttggagttagggtaaaggagatggtgctccattgatagtctgtcttgtaggtggccacagggcagccccatgagggctccagctactcttcgaggaaggactgtcagatggctctgaagcgagtggactatgcccgcctcaagctcagtgatgtggctcgaacctgtgagcagatgctggagaactaggccagggagatggacccagagctgagagggagaccatcacctgtgccatgggacagaacctgggaacatgtagggtggggagtatgagcaccaacataccctgctggtcaaagtaccctaggacaaaggggcaaatggtgggcatggaaaaactgaagcccgagcctgcccacagctatgccttggcctctccagcagggtgctcctgctctgcactccagaaacaccctgacaggctcagagaggagatggaaactgacatacccaacccacttcctcaaacacttcatgctgctgccccagccttcccgcagacttggcctaatgaaaatacatacttcttcattcggagagacaaaacaagaactagagttttaatgataataaaagcaataataataaaagcaataacaataaaaacaaaaaaaga

SEQ ID NO: 291275 - DNA, 964 bp, Homo sapiens
gagagccacttccggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggtactgtgatcctagaattgtccaaggaaaaaactaacgagcggctcctagaccggcaggcggcggccttcaccgcttcagtgcaacacgtggaggcggagctgtcagctcagatccgctacctcacccagctaccagatggcctaacaaattcaaactcagggaagaaatgagacgagacctgatgcctggttggagttagggtaaaggagatggtgctccattgatagtctgtcttgtaggtggccacagggcagccccatgagggctccagctactcttcgaggaaggactgtcagatggctctgaagcgagtggactatgcccgcctcaagctcagtgatgtggctcgaacctgtgagcagatgctggagaactaggccagggagatggacccagagctgagagggagaccatcacctgtgccatgggacagaacctgggaacatgtagggtggggagtatgagcaccaacataccctgctggtcaaagtaccctaggacaaaggggcaaatggtgggcatggaaaaactgaagcccgagcctgcccacagctatgccttggcctctccagcagggtgctcctgctctgcactccagaaacaccctgacaggctcagagaggagatggaaactgacatacccaacccacttcctcaaacacttcatgctgctgccccagccttcccgcagacttggcctaatgaaaatacatacttcttcattcggagagacaaaacaagaactagagttttaatgataataaaagcaataataataaaagcaataacaataaaaacaaaaaaaga

SEQ ID NO: 291276 - DNA, 917 bp, Homo sapiens
gagagccacttccggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggtactgtgatcctagaattgtccaaggaaaaaactaacgagcggctcctagaccggcaggcggcggccttcaccgcttcagtgcaacacgtggaggcggagctgtcagctcagatccgctacctcacccaggtggccacagggcagccccatgagggctccagctactcttcgaggaaggactgtcagatggctctgaagcgagtggactatgcccgcctcaagctcagtgatgtggctcgaacctgtgagcagatgctggagaactaggccagggagatggacccagagctgagagggagaccatcacctgtgccatgggacagaacctgggaacatgtagggtggggagtatgagcaccaacataccctgctggtcaaagtaccctaggacaaaggggcaaatggtgggcatggaaaaactgaagcccgagcctgcccacagctatgccttggcctctccagcagggtgctcctgctctgcactccagaaacaccctgacaggctcagagaggagatggaaactgacatacccaaccgagctgcccacaggttatgccttggcctctccagcagggtgtcctgctctggaatcccagaaaacaccttgaagggtcagagaggagatgggaatggataccaaccgaattcttcaaaatttcatggttgtgcccgcttcccggagattgggcaatgaataataatcttcctgggggaggcacccgattgcagttaggaaaaggcgcatattaaggggaactta

SEQ ID NO: 291277 - DNA, 930 bp, Homo sapiens
gagagccacttccggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggtactgtgatcctagaattgtccaaggaaaaaactaacgagcggctcctagaccggcaggcggcggccttcaccgcttcagtgcaacacgtggaggcggagctgtcagctcagatccgctacctcacccaggtcggtgtgtctggggggttctgcgagcgaaccccagctctgggtcaaagcctcaggcttgggtgatccagggtggagcattaactgggcaggaccagacctccccagccggccatccagagcgggtttcttcctctaaaaggaaagaatgggccgggcgcagtggcttgacagagttcgagaccagcctggccaacacggtgaaacctcgtctctactaaaaatataaaaattaggccaggctcggtggctcactcctgtaatcccagcactttgggaggctgaggcgggtggatcatctgaggtcaggagttcgagaccagcctggccaacatggtgaaactccgtctctactaaaaatacaaaaattagctgggctggtagcgggcacctgtaatcccagctacttggaagggtgaggcaggagaatcgcttgaacccaggaggtggaggttgcagtgagccaagattgcagcactgcactccagcctgggtgacaaagcaagactgtctcaaaaaaaaaaaaagccgggcttggtggtgagtaccggtaaccccagctacttggaaggctgaggcaggagaatcgcttgaacccaggaggcggaggttgttgtacttagccgagatcatgccattgcactc

SEQ ID NO: 291278 - DNA, 718 bp, Homo sapiens
gagagccacttccggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggtactgtgatcctagaattgtccaaggaaaaaactaacgagcggctcctagaccggcaggcggcggccttcaccgcttcagtgcaacacgtggaggcggagctgtcagctcagatccgctacctcacccaggtggccacagggcagccccatgagggctccagctactcttcgaggaaggactgtcagatggctctgaagcgagtggactatgcccgcctcaagctcagtgatgtggctcgaacctgtgagcagatgctggagaactaggccagggagatggacccagagctgagagggagaccatcacctgtgccatgggacaggtggccacagggcagccccatgagggctccagctactcttcgaggctcagagaggagatggaaactgacatacccaacccacttcctcaaacacttcatgctgctgccccagccttcccgcagacttggcctaatgaaaatacatacttcttcattcggagagacaaaacaagaactagagttttaatgataataaaagcaataataataaaagcaataacaataaaaacaaaaaaaga

SEQ ID NO: 291279 - DNA, 2163 bp, Homo sapiens
gcatgaggagagtgtgtaggggccgggttccgtggatgaactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291280 - DNA, 512 bp, Homo sapiens
  misc_feature (31)..(32): n is a, c, g, or t
ttatttttggatccagtcctaaagaaaaaannaaacctagagctacaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291281 - DNA, 555 bp, Homo sapiens
aagtcttaataatatttacttataagattttatatcgagagagaaacaagaaagacaacccctgatggagctgacaaagcattacgacttacaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291282 - DNA, 525 bp, Homo sapiens
gcgctcgtatactatctccgttttgccccgttatggtattgtttattaattaggggtctgagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291283 - DNA, 515 bp, Homo sapiens
tatcctaatttttgatccacatttgggatataattaataactcatactgcagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291284 - DNA, 508 bp, Homo sapiens
  misc_feature (47)..(47): n is a, c, g, or t
  misc_feature (63)..(63): n is a, c, g, or t
  misc_feature (68)..(68): n is a, c, g, or t
  misc_feature (111)..(111): n is a, c, g, or t
tgagagttctatactcggtagcgatcaaaaaaaaaaaaaaacttaanagtacagcatcgaacntctgnagagacaacgcagcaactggaaaacagctagaaaaaaatcagnttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291285 - DNA, 497 bp, Homo sapiens
  misc_feature (52)..(52): n is a, c, g, or t
  misc_feature (57)..(57): n is a, c, g, or t
  misc_feature (100)..(100): n is a, c, g, or t
aaattctataagtccacaagacggcgtaatgcgtagactgaagcatcgaacntctgnagagacaacgcagcaactggaaaacagctagaaaaaaatcagnttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291286 - DNA, 203 bp, Homo sapiens
atatcgtcgaccacggcgtccgatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291287 - DNA, 530 bp, Homo sapiens
gcatgaggagagtgtgtaggggccgggttccgtggatgaactctcacccgagcggtttctctttccgggacaacatggcgccgtccacgccgctcttgacagtccgaggatcagaaggactgtacatggtgaatggaccaccacattttacagaaagcacagtgtttccaaggtatgatttattttgttaagtaatgttatagggaacatacagtacaatctaaaatggttttgttggtggtgtattttgaacaagaaaggaaaagaacagatgaactcatttttattgtataatatttaccgaagatgaaaagaatacatattctctatcaaggaaaatgatcttcagatctgaaaatagtaacttaagcctatttataaggtagggggaacaatactaagaaaaagtgtagacactagtgtaattgaatacaagcctttattttacaagagttgtatcttaaggaatgagaaaaacttgcaaatttgatagccaaatcatggccagtaatcttagtgaaatcataatg

SEQ ID NO: 291288 - DNA, 3008 bp, Homo sapiens
gcatgaggagagtgtgtaggggccgggttccgtggatgaactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttagtatggaaagatttatgacataattttattacttactgtaatcgtatacagtttccattaacttttatgacatcatagggttttcctaaatactgttaatctattaatcaataattactcttacatacatttgcataattctttataagtctgaattcagtgaaaatctgtaacacaaaggttttcttttacaataactttttattatctggtaattgctattaagacatttgaatatcttttcctgaatttaattgctattgaaattctgtgacacaaattttttagatattttatcgtgtagaattttaaacttcagacacctagttctagtaaccatcagcttgtggccaatcttatctcatccatacatctctccagctaccatctcttactaagtgaaagcaaatcccagatatggttatacttttatatacttgttaaatatgtaattgtaaatatttcagagtagatttctgaagattggggcctttcattttttaaacttagccacaaaaccattatcacaaattattaaatatgtgttcaaatttctactaattgcaaatgttacaattttttttaaaactcgggatccaaataaggtactgcacattgtggttgattgatatatcttttatgtttcttttggtcctataagttcccactctatctgttattttattcttcataatttattgtttaagaaacaaggttatttgtctttcacgttttcccatagtttgaattttgcttttgtatcccatggtataatttaacatgttcatctgtcccctataaattgcaagttggctctagagtttcagcttcaggttcttttttagacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291289 - DNA, 2950 bp, Homo sapiens
gcatgaggagagtgtgtaggggccgggttccgtggatgaactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttagtatggaaagatttatgacataattttattacttactgtaatcgtatacagtttccattaacttttatgacatcatagggttttcctaaatactgttaatctattaatcaataattactcttacatacatttgcataattctttataagtctgaattcagtgaaaatctgtaacacaaaggttttcttttacaataactttttattatctggtaattgctattaagacatttgaatatcttttcctgaatttaattgctattgaaattctgtgacacaaattttttagatattttatcgtgtagaattttaaacttcagacacctagttctagtaaccatcagcttgtggccaatcttatctcatccatacatctctccagctaccatctcttactaagtgaaagcaaatcccagatatggttatacttttatatacttgttaaatatgtaattgtaaatatttcagagtagatttctgaagattggggcctttcattttttaaacttagccacaaaaccattatcaaaactcgggatccaaataaggtactgcacattgtggttgattgatatatcttttatgtttcttttggtcctataagttcccactctatctgttattttattcttcataatttattgtttaagaaacaaggttatttgtctttcacgttttcccatagtttgaattttgcttttgtatcccatggtataatttaacatgttcatctgtcccctataaattgcaagttggctctagagtttcagcttcaggttcttttttagacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291290 - DNA, 2049 bp, Homo sapiens
gcatgaggagagtgtgtaggggccgggttccgtggatgaactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291291 - DNA, 2147 bp, Homo sapiens
ggccccacggaacgcaggaaaacaacggctaaggatgcgaggcctgcgtgttagacgacatggcgcgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291292 - DNA, 2132 bp, Homo sapiens
atggcgcgcttactaacgtcagtgactggcaaaacctggacgacatggcgcgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291293 - DNA, 2100 bp, Homo sapiens
ggtttctctttccgggacatttgtgcgtcagtctgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291294 - DNA, 2092 bp, Homo sapiens
  misc_feature (26)..(26): n is a, c, g, or t
ggcacgaggcggcgtggacggcgcantgtagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291295 - DNA, 2194 bp, Homo sapiens
gcatgaggagagtgtgtaggggccgggttccgtggatgaactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaaaaaaaaaataaaaatggccttatttgcctca

SEQ ID NO: 291296 - DNA, 2019 bp, Homo sapiens
gcatgaggagagtgtgtaggggccgggttccgtggatgaactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttg

SEQ ID NO: 291297 - DNA, 2034 bp, Homo sapiens
gcatgaggagagtgtgtaggggccgggttccgtggatgaactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291298 - DNA, 2136 bp, Homo sapiens
ggtttctctttccgggacatttgtgcgtcagtctgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttattggctctagagtttcagcttcaggttcttttttagacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291299 - DNA, 2045 bp, Homo sapiens
atggcgcgcttactaacgtcagtgactggcaaaacctggacgacatggcgcgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291300 - DNA, 1293 bp, Homo sapiens
cttaaaaatcaaaggaagcatgaagctaagaaagctgcaagagcaggaagcaagaagtgacaagattttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291301 - DNA, 816 bp, Homo sapiens
taatcgagctcggtacctgccaaagcgtagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291302 - DNA, 1872 bp, Homo sapiens
gcatgaggagagtgtgtaggggccgggttccgtggatgaactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaatcagaactaagaagaaatggaagcatcgaacatgaagacagcgcatggaacagttgaaaatcgtggggaatcgaagaagctttcaggaggaattgatgggttacaatccggagagtgtgtccgaatctggcttttgtacctggtagattcgggactagggtatttactctccgttcaaggggtaggcgagg

SEQ ID NO: 291303 - DNA, 2074 bp, Homo sapiens
  misc_feature (2074)..(2074): n is a, c, g, or t
gcatgaggagagtgtgtaggggccgggttccgtggatgaactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaaggcctcgttggcctcagcggtggagctctgccggccggan

SEQ ID NO: 291304 - DNA, 1394 bp, Homo sapiens
gcatgaggagagtgtgtaggggccgggttccgtggatgaactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagcgctacatgtgctcccaggttacgggttaataatgaacaattggcatatcgctctatctgcacagtatggatgtccatcaatcagattatggcagttcggcaccattggatgatattcagcaacatactcaccccaaggttttccaagtcaggaacgctctagtggacggggttgtgacacggaacagctatgacat

SEQ ID NO: 291305 - DNA, 735 bp, Homo sapiens
  misc_feature (56)..(56): n is a, c, g, or t
  misc_feature (62)..(62): n is a, c, g, or t
  misc_feature (73)..(73): n is a, c, g, or t
  misc_feature (78)..(78): n is a, c, g, or t
  misc_feature (85)..(86): n is a, c, g, or t
  misc_feature (89)..(89): n is a, c, g, or t
  misc_feature (95)..(95): n is a, c, g, or t
  misc_feature (99)..(99): n is a, c, g, or t
  misc_feature (104)..(104): n is a, c, g, or t
  misc_feature (116)..(117): n is a, c, g, or t
  misc_feature (119)..(119): n is a, c, g, or t
  misc_feature (121)..(122): n is a, c, g, or t
  misc_feature (130)..(130): n is a, c, g, or t
  misc_feature (137)..(137): n is a, c, g, or t
  misc_feature (139)..(139): n is a, c, g, or t
  misc_feature (141)..(141): n is a, c, g, or t
  misc_feature (143)..(144): n is a, c, g, or t
  misc_feature (170)..(171): n is a, c, g, or t
  misc_feature (191)..(191): n is a, c, g, or t
  misc_feature (194)..(194): n is a, c, g, or t
ttcctaacttccatttttaaaaaaaaggtggctataactttttagaaaagtttccnccaganggcaagtccancctanccagagnncgncaggtnttcnccttncagctaccgaannananncccccttntgcaaangngntnngtcggatagctacgcctttggacagnngcacccattaaatggaacantgnttatgtctccccaccctcctccccactaatgcactaaaaagcttcaggagagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291306 - DNA, 522 bp, Homo sapiens
ccccctcatatatcaatttcccttgatgtaataattaataggggtttgtaggctacaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291307 - DNA, 2014 bp, Homo sapiens
gcatgaggagagtgtgtaggggccgggttccgtggatgaactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttagtatggaaagatttatgacataattttattacttactgtaatcgtatacagtttccattaacttttatgacatcatagggttttcctaaatactgttaatctattaatcaataattactcttacatacatttgcataattctttataagtctgaattcagtgaaaatctgtaacacaaaggttttcttttacaataactttttattatctggtaattgctattaagacatttgaatatcttttcctgaatttaattgctattgaaattctgtgacacaaattttttagatattttatcgtgtagaattttaaacttcagacacctagttctagtaaccatcagcttgtggccaatcttatctcatccatacatctctccagctaccatctcttactaagtgaaagcaaatcccagatatggttatacttttatatacttgttaaatatgtaattgtaaatatttcagagtagatttctgaagattggggcctttcattttttaaacttagccacaaaaccattatcacaaattattaaatatgtgttcaaatttctactaattgcaaatgttacaattttttttaaaactcgggatccaaataaggtactgcacattgtggttgattgatatatcttttatgtttcttttggtcctataagttcccactctatctgttattttattcttcataatttattgtttaagaaacaaggttatttgtctttcacgttttcccatagtttgaattttgcttttgtatcccatggtataatttaacatgttcatctgtcccctataaattgcaagttggctctagagtttcagcttcaggttcttttttaggtgagtaagggtaagactacattataaggtgatgttcacttcttttatcaagaagcacataatgtctggttgtctttaattttgtaggcttagctgacattaatgtttcatgcctggatgcattatttcatcagtggttgcaaattgttgatactctggttttttctccctcacttatttttcagctgtactgcttctataaagaaaaatttccccttctactatttggttacctagtgctgcatttatatagaaaaggcgggataaatattcttgctcttatcagttttaatataatgtattccacctctagcaaccttcattgtaaccaattagctttttccccattcttgtttttcgagagtgggcctcattcttttgtccaagctgagtgcaatcatggctcactgcaatctcgacttcctgggctcaagcaattctcctgcctcagcctcccaagtagctgggactacaggcttgcaccaccatgcccggctaatttttgattatttgtagagacaggatctcattatgttgcccaggctgttttttagttccattctttttttttttttttttttttttgagatggagtttcgctgttgttgcccgggctggag

SEQ ID NO: 291308 - DNA, 1833 bp, Homo sapiens
gcatgaggagagtgtgtaggggccgggttccgtggatgaactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttagtatggaaagatttatgacataattttattacttactgtaatcgtatacagtttccattaacttttatgacatcatagggttttcctaaatactgttaatctattaatcaataattactcttacatacatttgcataattctttataagtctgaattcagtgaaaatctgtaacacaaaggttttcttttacaataactttttattatctggtaattgctattaagacatttgaatatcttttcctgaatttaattgctattgaaattctgtgacacaaattttttagatattttatcgtgtagaattttaaacttcagacacctagttctagtaaccatcagcttgtggccaatcttatctcatccatacatctctccagctaccatctcttactaagtgaaagcaaatcccagatatggttatacttttatatacttgttaaatatgtaattgtaaatatttcagagtagatttctgaagattggggcctttcattttttaaacttagccacaaaaccattatcacaaattattaaatatgtgttcaaatttctactaattgcaaatgttacaattttttttaaaactcgggatccaaataaggtactgcacattgtggttgattgatatatcttttatgtttcttttggtcctataagttcccactctatctgttattttattcttcataatttattgtttaagaaacaaggttatttgtctttcacgttttcccatagtttgaattttgcttttgtatcccatggtataatttaacatgttcatctgtcccctataaattgcaagttggctctagagtttcagcttcaggttcttttttaggtgagtaagggtaagactacattataaggtgatgttcacttcttttatcaagaagcacataatgtctggttgtctttaattttgtaggcttagctgacattaatgtttcatgcctggatgcattatttcatcagtggttgcaaattgttgatactctggttttttctccctcacttatttttcagctgtactgcttctataaagaaaaatttccccttctactatttggttacctagtgctgcatttatatagaaaaggcgggataaatattcttgctcttatcagttttaatataatgtattccacctctagcaaccttcattgtaaccaattagctttttccccattcttgtttttcgagagtgggcctcattcttttgtccaaccgagatcgcaccactgcactccagcctgagcaacagagtgagactccgtctc

SEQ ID NO: 291309 - DNA, 538 bp, Homo sapiens
  misc_feature (22)..(22): n is a, c, g, or t
  misc_feature (34)..(34): n is a, c, g, or t
  misc_feature (47)..(47): n is a, c, g, or t
  misc_feature (62)..(63): n is a, c, g, or t
  misc_feature (93)..(93): n is a, c, g, or t
  misc_feature (98)..(98): n is a, c, g, or t
  misc_feature (141)..(141): n is a, c, g, or t
tggagtgggggtgtaaatatanaaaaaatatttntgactgaagttanaaataaaaaaagcgnnggggctttgttagctgaccagcatcgaacntctgnagagacaacgcagcaactggaaaacagctagaaaaaaatcagnttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291310 - DNA, 794 bp, Homo sapiens
ggccccacggaacgcaggaaaacaacggctaaggatgcgaggcctgcgtgttagacgacatggcgcgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagtatggagacaaactctcactcattggaacaatggggaaggga

SEQ ID NO: 291311 - DNA, 682 bp, Homo sapiens
  misc_feature (56)..(56): n is a, c, g, or t
  misc_feature (62)..(62): n is a, c, g, or t
  misc_feature (73)..(73): n is a, c, g, or t
  misc_feature (78)..(78): n is a, c, g, or t
  misc_feature (85)..(86): n is a, c, g, or t
  misc_feature (89)..(89): n is a, c, g, or t
  misc_feature (95)..(95): n is a, c, g, or t
  misc_feature (99)..(99): n is a, c, g, or t
  misc_feature (104)..(104): n is a, c, g, or t
  misc_feature (116)..(117): n is a, c, g, or t
  misc_feature (119)..(119): n is a, c, g, or t
  misc_feature (121)..(122): n is a, c, g, or t
  misc_feature (130)..(130): n is a, c, g, or t
  misc_feature (137)..(137): n is a, c, g, or t
  misc_feature (139)..(139): n is a, c, g, or t
  misc_feature (141)..(141): n is a, c, g, or t
  misc_feature (143)..(144): n is a, c, g, or t
  misc_feature (170)..(171): n is a, c, g, or t
  misc_feature (191)..(191): n is a, c, g, or t
  misc_feature (194)..(194): n is a, c, g, or t
ttcctaacttccatttttaaaaaaaaggtggctataactttttagaaaagtttccnccaganggcaagtccancctanccagagnncgncaggtnttcnccttncagctaccgaannananncccccttntgcaaangngntnngtcggatagctacgcctttggacagnngcacccattaaatggaacantgnttatgtctccccaccctcctccccactaatgcactaaaaagcttcaggagagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattgcatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaa

SEQ ID NO: 291312 - DNA, 379 bp, Homo sapiens
tggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaaaatcactgtttttattataagt

SEQ ID NO: 291313 - DNA, 424 bp, Homo sapiens
ctactgcactccttcgacctcctgaaggcagtttgccttgaattctcacccaaaaatactgtcctggcaacgtggcagccttacactagtaagtattttctcagtgtaaaaatactctgacacgatcaattacgtttagtgggggggaaaaagttataaagtttataacctcataagaaagtaattagtctttatgatagtaaatagtgtttgtgaatatttatgatctacagtgaatcttgtactctccaaataaacaatgtattgaaagtaatttcaaggtatatggtaagttaatgtaaagagccattatgagctaaaggaaaagaaaaagctcaagggaaaattcaggaagtaaataactgctggatagagatttctgaagattaagaataataatgacttttaaaatcaagacttttaa

SEQ ID NO: 291314 - DNA, 955 bp, Homo sapiens
  misc_feature (2)..(2): n is a, c, g, or t
  misc_feature (10)..(10): n is a, c, g, or t
  misc_feature (14)..(14): n is a, c, g, or t
cngccgtgtntttntgttcgtaaggggaggggacccctctccagaaaatgaccagcccacatgactagcacgctgagctctgcagggaccagtgccaggcactggggggtggaagtgtggtgacacagtgaatgggaggtggaggagggttgcagctcccacctcagtttagtttttaattcagggttttcaacctgtaacacattaaagctgtaattagcaatgaggctgtattttcattctgaagcttgtaacctccccattttagcactacagaattttcaagatttcaatatccaacaactagatagattaggacctctatccgagatgctttttccctgcccaaccctgtggccttcagggctcagagcagcaaaggcctgaagagtgagctctgggggttgttggtgtgggttgggagagagctgtgtgcagaagtctggaaacctgggtcctagtcccagctcttccatgggatccccctgtcaccctgagcaaatcagttgcttcctggacttgtgttacttcatctaattctcatgtggattggacgacttctgctccctttccagttctggcatctccccagtatggaagtcccggtggtctccccaagaagtccccaagacaatctcgccaaaggcacctcctatcctgctgcagtttcccagctgcagcctaggcaggggatgcacagcccaggcgaggaagcctggcttctctgtgagcacatacgtgggtcctcggcagctccctccaggctgtctgggcctccagacctgcacagggtgctcctgccacctcccacctctctgagggctgaggtgagacttctcctgggatgacaatttgctgagagagtgcagcttttgtgaattaaacttgaagtccaggcagaattctaatgcaataagctaaatgttcttgcaatttaagaagtgttcattcttta

SEQ ID NO: 291315 - DNA, 2391 bp, Homo sapiens
tgcgccgggggtgtgtacgccatgagggggaggaagccgagaagcacctcccactgaagccggcggtaaccgccccacgcgagaccacccaccagccaggagcggtcgcaggacccgcagcggcgcgaggccttgtttacaccgactgccgccactgcgttggccaaccgctcctccgtcacgcgcttcgctcgtcacgcatctcgcggcttcctggccggcgggctgcaaacgtcacacgacggccccgcccccttggccagccaactggacagcggagcacgatgattgataggccaataagatatgcaaatgatctccttaccttattggttggaggcctcaggaccacagatgacctcagagagctggccctttaagaatgccctttgggctctgtgcccacagccccctggagctgagcagaggcaccaggccctgctccatggagccttcagtctcctgggaagctgtgcctgtctggctctggcactgaccacatcctctcggccatttctgaagtgcactcctcccagcccagctccagaatggccctgccccccagccccctggccatggaatatgtcaatgactttgacttgatgaagtttgaggtaaagcgggaaccctctgagggccgacctggcccccctacagcctcactgggctccacaccttacagctcagtgcctccttcacccaccttcagtgaaccaggcatggtgggggcaaccgagggcacccggccaggcctggaggagctgtactggctggctaccctgcagcagcagctgggggctggggaggcattggggctgagtcctgaagaggccatggagctgctgcagggtcagggcccagtccctgttgatgggccccatggctactacccagggagcccagaggagacaggagcccagcacgtccagctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacaaaaacccagcccacatgactagcacgctgagctctgcagggaccagtgccaggcactggggggtggaagtgtggtgacacagtgaatgggaggtggaggagggttgcagctcccacctcagtttagtttttaattcagggttttcaacctgtaacacattaaagctgtaattagcaatgaggctgtattttcattctgaagcttgtaacctccccattttagcactacagaattttcaagatttcaatatccaacaactagatagattaggacctctatccgagatgctttttccctgcccaaccctgtggccttcagggctcagagcagcaaaggcctgaagagtgagctctgggggttgttggtgtgggttgggagagagctgtgtgcagaagtctggaaacctgggtcctagtcccagctcttccatgggatccccctgtcaccctgagcaaatcagttgcttcctggacttgtgttacttcatctaattctcatgtggattggacgacttctgctccctttccagttctggcatctccccagtatggaagtcccggtggtctccccaagaagtccccaagacaatctcgccaaaggcacctcctatcctgctgcagtttcccagctgcagcctaggcaggggatgcacagcccaggcgaggaagcctggcttctctgtgagcacatacgtgggtcctcggcagctccctccaggctgtctgggcctccagacctgcacagggtgctcctgccacctcccacctctctgagggctgaggtgagacttctcctgggatgacaatttgctgagagagtgcagcttttgtgaattaaacttgaagtccaggcagaattctaatgcaataagctaaatgttcttgcaatttaagaagtgttcattcttta

SEQ ID NO: 291316 - DNA, 1657 bp, Homo sapiens
tgcgccgggggtgtgtacgccatgagggggaggaagccgagaagcacctcccactgaagccggcggtaaccgccccacgcgagaccacccaccagccaggagcggtcgcaggacccgcagcggcgcgaggccttgtttacaccgactgccgccactgcgttggccaaccgctcctccgtcacgcgcttcgctcgtcacgcatctcgcggcttcctggccggcgggctgcaaacgtcacacgacggccccgcccccttggccagccaactggacagcggagcacgatgattgataggccaataagatatgcaaatgatctccttaccttattggttggaggcctcaggaccacagatgacctcagagagctggccctttaagaatgccctttgggctctgtgcccacagccccctggagctgagcagaggcaccaggccctgctccatggagccttcagtctcctgggaagctgtgcctgtctggctctggcactgaccacatcctctcggccatttctgaagtgcactcctcccagcccagctccagaatggccctgccccccagccccctggccatggaatatgtcaatgactttgacttgatgaagtttgaggtaaagcgggaaccctctgagggccgacctggcccccctacagcctcactgggctccacaccttacagctcagtgcctccttcacccaccttcagtgaaccaggcatggtgggggcaaccgagggcacccggccaggcctggaggagctgtactggctggctaccctgcagcagcagctgggggctggggaggcattggggctgagtcctgaagaggccatggagctgctgcagggtcagggcccagtccctgttgatgggccccatggctactacccagggagcccagaggagacaggagcccagcacgtccagctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacaaaaacccagcccacatgactagcacgctgagctctgcagggaccagtgccaggcactggggggtggaagtgtggtgacacagtgaatgggaggtggaggagggttgcagctcccacctcagtttagtttttaattcagggttttcaacctgtaacacattaaagctgtaattagc

SEQ ID NO: 291317 - DNA, 1839 bp, Homo sapiens
aaacaggacgagcctgggggctccaggcctggacggaggaagaagccagctatacggggtttctccatgctggccaagctggtctccaactcctgacctcgtgatccgcctgccttggcctcccaaagtgctggaatttacaggcgtgagccaccacgcccggcctggtcattctttctctccacaatccaatgaggaaactcatctgcccacccaactaccatcataaagtcctcaggtgatttctcaagctatacctccattgggacatctctctccaacctgagaccactggatatcacccacaatgctatatagcacctcaaactcagcatatctatgatgggtgtctgctcagcatccactcgccttttctgctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacaaaaacccagcccacatgactagcacgctgagctctgcagggaccagtgccaggcactggggggtggaagtgtggtgacacagtgaatgggaggtggaggagggttgcagctcccacctcagtttagtttttaattcagggttttcaacctgtaacacattaaagctgtaattagcaatgaggctgtattttcattctgaagcttgtaacctccccattttagcactacagaattttcaagatttcaatatccaacaactagatagattaggacctctatccgagatgctttttccctgcccaaccctgtggccttcagggctcagagcagcaaaggcctgaagagtgagctctgggggttgttggtgtgggttgggagagagctgtgtgcagaagtctggaaacctgggtcctagtcccagctcttccatgggatccccctgtcaccctgagcaaatcagttgcttcctggacttgtgttacttcatctaattctcatgtggattggacgacttctgctccctttccagttctggcatctccccagtatggaagtcccggtggtctccccaagaagtccccaagacaatctcgccaaaggcacctcctatcctgctgcagtttcccagctgcagcctaggcaggggatgcacagcccaggcgaggaagcctggcttctctgtgagcacatacgtgggtcctcggcagctccctccaggctgtctgggcctccagacctgcacagggtgctcctgccacctcccacctctctgagggctgaggtgagacttctcctgggatgacaatttgctgagagagtgcagcttttgtgaattaaacttgaagtccaggcagaattctaatgcaataagctaaatgttcttgcaatttaagaagtgttcattcttta

SEQ ID NO: 291318 - DNA, 1711 bp, Homo sapiens
ggagggttgggggctgtctgggtgcgggtccactggacacacccgggcctggagctggatgccggggatcccagagacgagcccggggtttaggtgcgcgacgggctcgcctgaccgtggccggccctgcaccgtggggcgcccgcctgactggagcaacggtcagctggggggcccggggagcgtcggggcctggggcgggctctggaccgaaacagactgcgtggaagggcgagccttccggtgaagctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacaaaaacccagcccacatgactagcacgctgagctctgcagggaccagtgccaggcactggggggtggaagtgtggtgacacagtgaatgggaggtggaggagggttgcagctcccacctcagtttagtttttaattcagggttttcaacctgtaacacattaaagctgtaattagcaatgaggctgtattttcattctgaagcttgtaacctccccattttagcactacagaattttcaagatttcaatatccaacaactagatagattaggacctctatccgagatgctttttccctgcccaaccctgtggccttcagggctcagagcagcaaaggcctgaagagtgagctctgggggttgttggtgtgggttgggagagagctgtgtgcagaagtctggaaacctgggtcctagtcccagctcttccatgggatccccctgtcaccctgagcaaatcagttgcttcctggacttgtgttacttcatctaattctcatgtggattggacgacttctgctccctttccagttctggcatctccccagtatggaagtcccggtggtctccccaagaagtccccaagacaatctcgccaaaggcacctcctatcctgctgcagtttcccagctgcagcctaggcaggggatgcacagcccaggcgaggaagcctggcttctctgtgagcacatacgtgggtcctcggcagctccctccaggctgtctgggcctccagacctgcacagggtgctcctgccacctcccacctctctgagggctgaggtgagacttctcctgggatgacaatttgctgagagagtgcagcttttgtgaattaaacttgaagtccaggcagaattctaatgcaataagctaaatgttcttgcaatttaagaagtgttcattcttta

SEQ ID NO: 291319 - DNA, 1757 bp, Homo sapiens
tgcgccgggggtgtgtacgccatgagggggaggaagccgagaagcacctcccactgaagccggcggtaaccgccccacgcgagaccacccaccagccaggagcggtcgcaggacccgcagcggcgcgaggccttgtttacaccgactgccgccactgcgttggccaaccgctcctccgtcacgcgcttcgctcgtcacgcatctcgcggcttcctggccggcgggctgcaaacgtcacacgacggccccgcccccttggccagccaactggacagcggagcacgatgattgatagctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacaaaaacccagcccacatgactagcacgctgagctctgcagggaccagtgccaggcactggggggtggaagtgtggtgacacagtgaatgggaggtggaggagggttgcagctcccacctcagtttagtttttaattcagggttttcaacctgtaacacattaaagctgtaattagcaatgaggctgtattttcattctgaagcttgtaacctccccattttagcactacagaattttcaagatttcaatatccaacaactagatagattaggacctctatccgagatgctttttccctgcccaaccctgtggccttcagggctcagagcagcaaaggcctgaagagtgagctctgggggttgttggtgtgggttgggagagagctgtgtgcagaagtctggaaacctgggtcctagtcccagctcttccatgggatccccctgtcaccctgagcaaatcagttgcttcctggacttgtgttacttcatctaattctcatgtggattggacgacttctgctccctttccagttctggcatctccccagtatggaagtcccggtggtctccccaagaagtccccaagacaatctcgccaaaggcacctcctatcctgctgcagtttcccagctgcagcctaggcaggggatgcacagcccaggcgaggaagcctggcttctctgtgagcacatacgtgggtcctcggcagctccctccaggctgtctgggcctccagacctgcacagggtgctcctgccacctcccacctctctgagggctgaggtgagacttctcctgggatgacaatttgctgagagagtgcagcttttgtgaattaaacttgaagtccaggcagaattctaatgcaataagctaaatgttcttgcaatttaagaagtgttcattcttta

SEQ ID NO: 291320 - DNA, 498 bp, Homo sapiens
aaacaggacgagcctgggggctccaggcctggacggaggaagaagccagctatacggggtttctccatgctggccaagctggtctccaactcctgacctcgtgatccgcctgccttggcctcccaaagtgctggaatttacaggcgtgagccaccacgcccggcctggtcattctttctctccacaatccaatgaggaaactcatctgcccacccaactaccatcataaagtcctcaggtgcactcctcccagcccagctccagaatggccctgccccccagccccctggccatggaatatgtcaatgactttgacttgatgaagtttgaggtaaagcgggaaccctctgagggccgacctggcccccctacagcctcatggggggtggaagtgtggtgacacagtgaatgggaggtggaggagggttgcagctcccacctcagtttagtttttaattcagggttttcaacctgtaacacattaaagctgtaattagc

SEQ ID NO: 291321 - DNA, 534 bp, Homo sapiens
gggttgcttccatttgggattactataaataaacttgtcataaatatttatgtgccagtcattggatggacaagtttgaattttcttggaaaaatagctaggagtagagttgctgggtcatatgttaagcttatatttttatataaggagctgctaacctgttttccaaagtggtttgagacaggattttgctgtgttgcccagcctggagtgcacagaataagagaataaaccaagaaacaggaagacgtgatccaggcaacaggatattccagtataggtgagaaataagaaagtctccaagatgataatgaagggaaatcctagggtgatagctggcctggcagcaggcctagggagcaatcagtaaggctggagccagaggacaaaagcctccaggagggaggtacccaagaaataagatgaaatgaatacaggaaaaatctacacttttagtgaatgatggagaataaattcatgattggaacatagaaaactaagcaaataaatcccaattttgtttttaggtataat

SEQ ID NO: 291322 - DNA, 441 bp, Homo sapiens
ctcaggaaactactggaggatgtggtgcaccagaataagagaataaaccaagaaacaggaagacgtgatccaggcaacaggatattccagtatagtgttggaaacagaagcccagtagtgaaagctacagctgccatatacttgcagtggaatcacaggagcaatcacaggtctttacactccaggaaaaacagaatcttttaatcagcaaaatccatcatattacttaagtcacagatgctcaccaaggagaagaggtcattctgtaatccaagtcgatccacagggggcagagaaaggtcacgaatgcctggtaataaactttccagcatggcagagctgtactgggtccgataaaacccaactgttcctaagtttaactgcaaagatatccagtaagtactattaaacagctccattaattttttaaatcaacctttt

SEQ ID NO: 291323 - DNA, 545 bp, Homo sapiens
gggttgcttccatttgggattactataaataaacttgtcataaatatttatgtgccagtcattggatggacaagtttgaattttcttggaaaaatagctaggagtagagttgctgggtcatatgttaagcttatatttttatataaggagctgctaacctgttttccaaagtggtttgagacaggattttgctgtgttgcccagcctggagtgcacagaataagagaataaaccaagaaacaggaagacgtgatccaggcaacaggatattccagtatagacactccaggaaaaacagaatcttttaatcagcaaaatccatcatattacttaagtcacagatgctcaccaaggagaagaggtcattctgtaatccaagtcgatccacagggggcagagaaaggtcacgaatgcctggtaataaactttccagcatggcagagctgtactgggtccgataaaacccaactgttcctaagtttaactgcaaagatatccagtaagtactattaaacagctccattaattttttaaatcaacctttt

SEQ ID NO: 291324 - DNA, 4576 bp, Homo sapiens
  misc_feature (2)..(2): n is a, c, g, or t
  misc_feature (572)..(572): n is a, c, g, or t
ancaatataatctggcgaatgcaattgaggctgccgatgcctacacagtgtttgctccaaacaacaatgccatcgagaattacatcagggagaagaaagtcttgtctctagaggaggacgtcctccggtatcatgtggtcctggaggagaaactcctgaagaatgacctgcacaatggcatgcatcgtgagaccatgctgggtttctcctatttccttagcttctttctccataatgaccagctctatgtaaatgaggctccaataaactacaccaatgtagccactgataagggagtgatccatggcttgggaaaagttctggaaattcagaagaacagatgtgataataatgacactactattatacgaggaagatgtaggacatgctcctcagagctgacctgcccattcggaactaaatctctaggtaatgagaagaggagatgcatctatacctcctatttcatgggaagacgaaccctgtttattgggtgccagccaaaatgtgtgagaaccgtcattacgagagaatgctgtgccggcttctttggcccccaatgccagccctgnccagggaatgcccagaatgtctgctttggtaatggcatctgtttggatggagtgaatggcacaggtgtgtgtgagtgtggggagggcttcagcggcacagcctgcgagacctgcaccgagggcaagtacggcatccactgtgaccaagcatgttcttgtgtccatgggagatgcaaccaaggacccttgggagatggctcctgtgactgtgatgttggctggcgaggagtgcattgtgacaatgcaaccacagaagacaactgcaatgggacatgccataccagcgccaactgcctcaccaactcagatggtacagcttcatgcaagtgtgcagcaggattccaaggaaacgggaccatctgcacagcaatcaatgcctgtgagatcagcaatggaggttgctctgccaaggctgactgtaagagaaccaccccaggaaggcgagtgtgcacgtgcaaagcaggctacacgggtgatggcattgtgtgcctggaaatcaacccgtgtttggagaaccatggtggctgtgacaagaatgcggagtgcacacagacaggacccaaccaggctgcctgtaactgtttgccagcatacactggagatggaaaggtctgcacactcatcaatgtctgcttaactaaaaatggcggctgtagtgaatttgccatctgcaaccacactgggcaagtagaaaggacttgtacttgcaagccaaactacattggagatggatttacctgccgcggcagcatttatcaggagcttcccaagaacccgaaaacttcccagtatttcttccagttgcaggagcatttcgtgaaagatctggtcggcccaggccccttcactgtttttgcacctttatctgcagcctttgatgaggaagctcgggttaaagactgggacaaatacggtttaatgccccaggttcttcggtaccatgtggtcgcctgccaccagctgcttctggaaaacctgaaattgatctcaaatgctacttccctccaaggagagccaatagtcatctccgtctctcagagcacggtgtatataaataataaggctaagatcatatccagtgatatcatcagtactaatgggattgttcatatcatagacaaattgctatctcccaaaaatttgcttatcactcccaaagacaactctggaagaattctgcaaaatcttacgactttggcaacaaacaatggctacatcaaatttagcaacttaatacaggactcaggtttgctgagtgtcatcaccgatcccatccacaccccagtcactctcttctggcccaccgaccaagccctccatgccctacctgctgaacaacaggacttcctgttcaaccaagacaacaaggacaagctgaaggagtatttgaagtttcatgtgatacgagatgccaaggttttagctgtggatcttcccacatccactgcctggaagaccctgcaaggttcagagctgagtgtgaaatgtggagctggcagggacatcggtgacctctttctgaatggccaaacctgcagaattgtgcagcgggagctcttgtttgacctgggtgtggcctacggcattgactgtctgctgattgatcccaccctggggggccgctgtgacacctttactactttcgatgcctcgggggagtgtgggagctgtgtcaatactcccagctgcccaaggtggagtaaaccaaagggtgtgaagcagaagtgtctctacaacctgcccttcaagaggaacctggaaggctgccgggagcggtgcagcctggtgatacagatccccaggtgctgcaagggctacttcgggcgagactgtcaggcctgccctggaggaccagatgccccgtgtaataaccggggtgtctgccttgatcagtactcggccaccggagagtgtaaatgcaacaccggcttcaatgggacggcgtgtgagatgtgctggccggggagattcgggcctgattgtctgccctgtggctgctcagaccacggacagtgcgatgatggcatcacgggctccgggcagtgcctctgtgaaacggggtggacaggcccctcgtgtgacactcaggcagttttgcctgcagtgtgtacgcctccttgttctgctcatgccacctgtaaggagaacaacacgtgtgagtgtaacctggattatgaaggtgacggaatcacatgcacagttgtggatttctgcaaacaggacaacgggggctgtgcaaaggtggccagatgctcccagaagggcacgaaggtctcctgcagctgccagaagggatacaaaggggacgggcacagctgcacagagatagacccctgtgcagacggccttaacggagggtgtcacgagcacgccacctgtaagatgacaggcccgggcaagcacaagtgtgagtgtaaaagtcactatgtcggagatgggctgaactgtgagccggagcagctgcccattgaccgctgcttacaggacaatgggcagtgccatgcagacgccaaatgtgtcgacctccacttccaggataccactgttggggtgttccatctacgctccccactgggccagtataagctgacctttgacaaagccagagaggcctgtgccaacgaagctgcgaccatggcaacctacaaccagctctcctatgcccagaaggccaagtaccacctgtgctcagcaggctggctggagaccgggcgggttgcctaccccacagccttcgcctcccagaactgtggctctggtgtggttgggatagtggactatggacctagacccaacaagagtgaaatgtgggatgtcttctgctatcggatgaaagatgtgaactgcacctgcaaggtgggctatgtgggagatggcttctcatgcagtgggaacctgctgcaggtcctgatgtccttcccctcactcacaaacttcctgacggaagtgctggcctattccaacagctcagctcgaggccgtgcatttctagaacacctgactgacctgtccatccgcggcaccctctttgtgccacagaacagtgggctgggggagaatgagaccttgtctgggcgggacatcgagcaccacctcgccaatgtcagcatgtttttctacaatgaccttgtcaatggcaccaccctgcaaacgaggctgggaagcaagctgctcatcactgccagccaggacccactccaaccgacggagaccaggtttgttgatggaagagccattctgcagtgggacatctttgcctccaatgggatcattcatgtcatttccaggcctttaaaagcaccccctgcccccgtgaccttgacccacactggcttgggagcagggatcttctttgccatcatcctggtgactggggctgttgccttggctgcttactcctactttcggataaaccggagaacaatcggcttccagcattttgagtcggaagaggacattaatgttgcagctcttggcaagcagcagcctgagaatatctcgaaccccttgtatgagagcacaacctcagctcccccagaaccttcctacgaccccttcacggactctgaagaacggcagcttgagggcaatgaccccttgaggacactgtgagggcctggacgggagatgccagccatcactcactgccacctgggcccatcaactgtgaattctcagcaccagttgccttttaggaacgtaaagtcctttaagcactcagaagccatacctcatctctctggctgatctgggggttgtttctgtgggtgagagatgtgttgctgtgcccacccagtacagcttcctcctctgaccctttggctcttcttcctttgtactcttcagctggcacctgctccattctgccctacatgatgggtaactgtgatctttcttccctgttagattgtaagcctccgtctttgtatcccagcccctagcccagtgcctgacacaggaactgtgcacaataaaggtttatggaacagaaacaaagtcaacag

SEQ ID NO: 291325 - DNA, 442 bp, Homo sapiens
cttgctagattctgtctcctgcacccctgccctttttgtgattcaagacccctgttaaagactatggattcccctagaagtaggttggagaattaagtgcaataaagcaaaccctagtaaatgacaaatgagttattgaacatgggttagaatctgacgatttgcaggtgattttcccacttagcatgttcttgtgtccatgggagatgcaaccaaggacccttgggagatggctcctgtgactgtgatgttggctggcgaggagtgcattgtgacaatggtaagagtgaggcctccagtatttataatctgctctaagctttgcttctcagcagctacatttttctttctaaaatataaatgacacctttttttacttcttctggcaataaacatgattctttcttgcagcaaaaagtttgtaaaataaagaaaagcagaa

SEQ ID NO: 291326 - DNA, 3938 bp, Homo sapiens
tggctttgagcttcatggcagccagtataaaaaaggattgacatgacctcatagttttatatcgctcacatgatacatatcacttccaaagaagtagcttttctgagcacaaaatactaaaaatcctcaggtgagatttagtaagagggctaagacagcaactggttctctttttcagcaaccacagaagacaactgcaatgggacatgccataccagcgccaactgcctcaccaactcagatggtacagcttcatgcaagtgtgcagcaggattccaaggaaacgggaccatctgcacagcaatcaatgcctgtgagatcagcaatggaggttgctctgccaaggctgactgtaagagaaccaccccaggaaggcgagtgtgcacgtgcaaagcaggctacacgggtgatggcattgtgtgcctggaaatcaacccgtgtttggagaaccatggtggctgtgacaagaatgcggagtgcacacagacaggacccaaccaggctgcctgtaactgtttgccagcatacactggagatggaaaggtctgcacactcatcaatgtctgcttaactaaaaatggcggctgtagtgaatttgccatctgcaaccacactgggcaagtagaaaggacttgtacttgcaagccaaactacattggagatggatttacctgccgcggcagcatttatcaggagcttcccaagaacccgaaaacttcccagtatttcttccagttgcaggagcatttcgtgaaagatctggtcggcccaggccccttcactgtttttgcacctttatctgcagcctttgatgaggaagctcgggttaaagactgggacaaatacggtttaatgccccaggttcttcggtaccatgtggtcgcctgccaccagctgcttctggaaaacctgaaattgatctcaaatgctacttccctccaaggagagccaatagtcatctccgtctctcagagcacggtgtatataaataataaggctaagatcatatccagtgatatcatcagtactaatgggattgttcatatcatagacaaattgctatctcccaaaaatttgcttatcactcccaaagacaactctggaagaattctgcaaaatcttacgactttggcaacaaacaatggctacatcaaatttagcaacttaatacaggactcaggtttgctgagtgtcatcaccgatcccatccacaccccagtcactctcttctggcccaccgaccaagccctccatgccctacctgctgaacaacaggacttcctgttcaaccaagacaacaaggacaagctgaaggagtatttgaagtttcatgtgatacgagatgccaaggttttagctgtggatcttcccacatccactgcctggaagaccctgcaaggttcagagctgagtgtgaaatgtggagctggcagggacatcggtgacctctttctgaatggccaaacctgcagaattgtgcagcgggagctcttgtttgacctgggtgtggcctacggcattgactgtctgctgattgatcccaccctggggggccgctgtgacacctttactactttcgatgcctcgggggagtgtgggagctgtgtcaatactcccagctgcccaaggtggagtaaaccaaagggtgtgaagcagaagtgtctctacaacctgcccttcaagaggaacctggaaggctgccgggagcggtgcagcctggtgatacagatccccaggtgctgcaagggctacttcgggcgagactgtcaggcctgccctggaggaccagatgccccgtgtaataaccggggtgtctgccttgatcagtactcggccaccggagagtgtaaatgcaacaccggcttcaatgggacggcgtgtgagatgtgctggccggggagattcgggcctgattgtctgccctgtggctgctcagaccacggacagtgcgatgatggcatcacgggctccgggcagtgcctctgtgaaacggggtggacaggcccctcgtgtgacactcaggcagttttgcctgcagtgtgtacgcctccttgttctgctcatgccacctgtaaggagaacaacacgtgtgagtgtaacctggattatgaaggtgacggaatcacatgcacagttgtggatttctgcaaacaggacaacgggggctgtgcaaaggtggccagatgctcccagaagggcacgaaggtctcctgcagctgccagaagggatacaaaggggacgggcacagctgcacagagatagacccctgtgcagacggccttaacggagggtgtcacgagcacgccacctgtaagatgacaggcccgggcaagcacaagtgtgagtgtaaaagtcactatgtcggagatgggctgaactgtgagccggagcagctgcccattgaccgctgcttacaggacaatgggcagtgccatgcagacgccaaatgtgtcgacctccacttccaggataccactgttggggtgttccatctacgctccccactgggccagtataagctgacctttgacaaagccagagaggcctgtgccaacgaagctgcgaccatggcaacctacaaccagctctcctatgcccagaaggccaagtaccacctgtgctcagcaggctggctggagaccgggcgggttgcctaccccacagccttcgcctcccagaactgtggctctggtgtggttgggatagtggactatggacctagacccaacaagagtgaaatgtgggatgtcttctgctatcggatgaaagatgtgaactgcacctgcaaggtgggctatgtgggagatggcttctcatgcagtgggaacctgctgcaggtcctgatgtccttcccctcactcacaaacttcctgacggaagtgctggcctattccaacagctcagctcgaggccgtgcatttctagaacacctgactgacctgtccatccgcggcaccctctttgtgccacagaacagtgggctgggggagaatgagaccttgtctgggcgggacatcgagcaccacctcgccaatgtcagcatgtttttctacaatgaccttgtcaatggcaccaccctgcaaacgaggctgggaagcaagctgctcatcactgccagccaggacccactccaaccgacggagaccaggtttgttgatggaagagccattctgcagtgggacatctttgcctccaatgggatcattcatgtcatttccaggcctttaaaagcaccccctgcccccgtgaccttgacccacactggcttgggagcagggatcttctttgccatcatcctggtgactggggctgttgccttggctgcttactcctactttcggataaaccggagaacaatcggcttccagcattttgagtcggaagaggacattaatgttgcagctcttggcaagcagcagcctgagaatatctcgaaccccttgtatgagagcacaacctcagctcccccagaaccttcctacgaccccttcacggactctgaagaacggcagcttgagggcaatgaccccttgaggacactgtgagggcctggacgggagatgccagccatcactcactgccacctgggcccatcaactgtgaattctcagcaccagttgccttttaggaacgtaaagtcctttaagcactcagaagccatacctcatctctctggctgatctgggggttgtttctgtgggtgagagatgtgttgctgtgcccacccagtacagcttcctcctctgaccctttggctcttcttcctttgtactcttcagctggcacctgctccattctgccctacatgatgggtaactgtgatctttcttccctgttagattgtaagcctccgtctttgtatcccagcccctagcccagtgcctgacacaggaactgtgcacaataaaggtttatggaacagaaacaaagtcaacag

SEQ ID NO: 291327 - DNA, 1736 bp, Homo sapiens
caagaaagagaggacacttttgttcacccagtggctcaatcaatcagtcaacatctaatgaccacctactgtgtgccaggcacagaggtgcaataggcaaagtgagactttatgggttttatggcctaataggggaatcagacattaaccaagtgatgccacaacacatgaacttgcagctgacccatggccctgtctgtatccctgcaggccaagtaccacctgtgctcagcaggctggctggagaccgggcgggttgcctaccccacagccttcgcctcccagaactgtggctctggtgtggttgggatagtggactatggacctagacccaacaagagtgaaatgtgggatgtcttctgctatcggatgaaagatgtgaactgcacctgcaaggtgggctatgtgggagatggcttctcatgcagtgggaacctgctgcaggtcctgatgtccttcccctcactcacaaacttcctgacggattcactgaggaaaggaaaagtcctcaaactctcccacggcgcaggcagaagacacagcaaaggagcagcaggctgagttggctcacaccatgaatattcacagatgggtgatgccctgggaccttcttcagccacccaggtccctgcacaccagggctggcccctctgatgacttccttcttctccccaggaagtgctggcctattccaacagctcagctcgaggccgtgcatttctagaacacctgactgacctgtccatccgcggcaccctctttgtgccacagaacagtgggctgggggagaatgagaccttgtctgggcgggacatcgagcaccacctcgccaatgtcagcatgtttttctacaatgaccttgtcaatggcaccaccctgcaaacgaggctgggaagcaagctgctcatcactgccagccaggacccactccaaccgacggagaccaggtttgttgatggaagagccattctgcagtgggacatctttgcctccaatgggatcattcatgtcatttccaggcctttaaaagcaccccctgcccccgtgaccttgacccacactggcttgggagcagggatcttctttgccatcatcctggtgactggggctgttgccttggctgcttactcctactttcggataaaccggagaacaatcggcttccagcattttgagtcggaagaggacattaatgttgcagctcttggcaagcagcagcctgagaatatctcgaaccccttgtatgagagcacaacctcagctcccccagaaccttcctacgaccccttcacggactctgaagaacggcagcttgagggcaatgaccccttgaggacactgtgagggcctggacgggagatgccagccatcactcactgccacctgggcccatcaactgtgaattctcagcaccagttgccttttaggaacgtaaagtcctttaagcactcagaagccatacctcatctctctggctgatctgggggttgtttctgtgggtgagagatgtgttgctgtgcccacccagtacagcttcctcctctgaccctttggctcttcttcctttgtactcttcagctggcacctgctccattctgccctacatgatgggtaactgtgatctttcttccctgttagattgtaagcctccgtctttgtatcccagcccctagcccagtgcctgacacaggaactgtgcacaataaaggtttatggaacagaaacaaagtcaacag

SEQ ID NO: 291328 - DNA, 4833 bp, Homo sapiens
  misc_feature (2)..(2): n is a, c, g, or t
  misc_feature (572)..(572): n is a, c, g, or t
ancaatataatctggcgaatgcaattgaggctgccgatgcctacacagtgtttgctccaaacaacaatgccatcgagaattacatcagggagaagaaagtcttgtctctagaggaggacgtcctccggtatcatgtggtcctggaggagaaactcctgaagaatgacctgcacaatggcatgcatcgtgagaccatgctgggtttctcctatttccttagcttctttctccataatgaccagctctatgtaaatgaggctccaataaactacaccaatgtagccactgataagggagtgatccatggcttgggaaaagttctggaaattcagaagaacagatgtgataataatgacactactattatacgaggaagatgtaggacatgctcctcagagctgacctgcccattcggaactaaatctctaggtaatgagaagaggagatgcatctatacctcctatttcatgggaagacgaaccctgtttattgggtgccagccaaaatgtgtgagaaccgtcattacgagagaatgctgtgccggcttctttggcccccaatgccagccctgnccagggaatgcccagaatgtctgctttggtaatggcatctgtttggatggagtgaatggcacaggtgtgtgtgagtgtggggagggcttcagcggcacagcctgcgagacctgcaccgagggcaagtacggcatccactgtgaccaagcatgttcttgtgtccatgggagatgcaaccaaggacccttgggagatggctcctgtgactgtgatgttggctggcgaggagtgcattgtgacaatgcaaccacagaagacaactgcaatgggacatgccataccagcgccaactgcctcaccaactcagatggtacagcttcatgcaagtgtgcagcaggattccaaggaaacgggaccatctgcacagcaatcaatgcctgtgagatcagcaatggaggttgctctgccaaggctgactgtaagagaaccaccccaggaaggcgagtgtgcacgtgcaaagcaggctacacgggtgatggcattgtgtgcctggaaatcaacccgtgtttggagaaccatggtggctgtgacaagaatgcggagtgcacacagacaggacccaaccaggctgcctgtaactgtttgccagcatacactggagatggaaaggtctgcacactcatcaatgtctgcttaactaaaaatggcggctgtagtgaatttgccatctgcaaccacactgggcaagtagaaaggacttgtacttgcaagccaaactacattggagatggatttacctgccgcggcagcatttatcaggagcttcccaagaacccgaaaacttcccagtatttcttccagttgcaggagcatttcgtgaaagatctggtcggcccaggccccttcactgtttttgcacctttatctgcagcctttgatgaggaagctcgggttaaagactgggacaaatacggtttaatgccccaggttcttcggtaccatgtggtcgcctgccaccagctgcttctggaaaacctgaaattgatctcaaatgctacttccctccaaggagagccaatagtcatctccgtctctcagagcacggtgtatataaataataaggctaagatcatatccagtgatatcatcagtactaatgggattgttcatatcatagacaaattgctatctcccaaaaatttgcttatcactcccaaagacaactctggaagaattctgcaaaatcttacgactttggcaacaaacaatggctacatcaaatttagcaacttaatacaggactcaggtttgctgagtgtcatcaccgatcccatccacaccccagtcactctcttctggcccaccgaccaagccctccatgccctacctgctgaacaacaggacttcctgttcaaccaagacaacaaggacaagctgaaggagtatttgaagtttcatgtgatacgagatgccaaggttttagctgtggatcttcccacatccactgcctggaagaccctgcaaggttcagagctgagtgtgaaatgtggagctggcagggacatcggtgacctctttctgaatggccaaacctgcagaattgtgcagcgggagctcttgtttgacctgggtgtggcctacggcattgactgtctgctgattgatcccaccctggggggccgctgtgacacctttactactttcgatgcctcgggggagtgtgggagctgtgtcaatactcccagctgcccaaggtggagtaaaccaaagggtgtgaagcagaagtgtctctacaacctgcccttcaagaggaacctggaaggctgccgggagcggtgcagcctggtgatacagatccccaggtgctgcaagggctacttcgggcgagactgtcaggcctgccctggaggaccagatgccccgtgtaataaccggggtgtctgccttgatcagtactcggccaccggagagtgtaaatgcaacaccggcttcaatgggacggcgtgtgagatgtgctggccggggagattcgggcctgattgtctgccctgtggctgctcagaccacggacagtgcgatgatggcatcacgggctccgggcagtgcctctgtgaaacggggtggacaggcccctcgtgtgacactcaggcagttttgcctgcagtgtgtacgcctccttgttctgctcatgccacctgtaaggagaacaacacgtgtgagtgtaacctggattatgaaggtgacggaatcacatgcacagttgtggatttctgcaaacaggacaacgggggctgtgcaaaggtggccagatgctcccagaagggcacgaaggtctcctgcagctgccagaagggatacaaaggggacgggcacagctgcacagagatagacccctgtgcagacggccttaacggagggtgtcacgagcacgccacctgtaagatgacaggcccgggcaagcacaagtgtgagtgtaaaagtcactatgtcggagatgggctgaactgtgagccggagcagctgcccattgaccgctgcttacaggacaatgggcagtgccatgcagacgccaaatgtgtcgacctccacttccaggataccactgttggggtgttccatctacgctccccactgggccagtataagctgacctttgacaaagccagagaggcctgtgccaacgaagctgcgaccatggcaacctacaaccagctctcctatgcccagaaggccaagtaccacctgtgctcagcaggctggctggagaccgggcgggttgcctaccccacagccttcgcctcccagaactgtggctctggtgtggttgggatagtggactatggacctagacccaacaagagtgaaatgtgggatgtcttctgctatcggatgaaagatgtgaactgcacctgcaaggtgggctatgtgggagatggcttctcatgcagtgggaacctgctgcaggtcctgatgtccttcccctcactcacaaacttcctgacggaagtgctggcctattccaacagctcagctcgaggccgtgcatttctagaacacctgactgacctgtccatccgcggcaccctctttgtgccacagaacagtgggctgggggagaatgagaccttgtctgggcgggacatcgagcaccacctcgccaatgtcagcatgtttttctacaatgaccttgtcaatggcaccaccctgcaaacgaggctgggaagcaagctgctcatcactgccagccaggacccactccaaccgacggagaccaggtttgttgatggaagagccattctgcagtgggacatctttgcctccaatgggatcattcatgtcatttccaggcctttaaaagcaccccctgcccccgtgaccttgacccacactggcttgggagcagggatcttctttgccatcatcctggtgactggggctgttgccttggctgcttactcctactttcggataaaccggagaacaatcggcttccagcattttgagtcggaagaggacattaatgttgcagctcttggcaagcagcagcctgagaatatctcgaaccccttgtatgagagcacaacctcagctcccccagaaccttcctacgaccccttcacgatgaagaaactgcagccgagttgggatgatttgtcttgggccacccagcttcaagcaggagagactaaaacaggtggccctacccccagcccatcctgcctcccaacacaaggcagcagcacaaacaaacacgcccagcacatacgtgttcacagtgctcagggagagtcatgcctcagaccagtggccaccagaaagattcaactaggactcaacacacagaatgccctgcccccttacaaccctctcttttccaggactctgaagaacggcagcttgagggcaatgaccccttgaggacactgtgagggcctggacgggagatgccagccatcactcactgccacctgggcccatcaactgtgaattctcagcaccagttgccttttaggaacgtaaagtcctttaagcactcagaagccatacctcatctctctggctgatctgggggttgtttctgtgggtgagagatgtgttgctgtgcccacccagtacagcttcctcctctgaccctttggctcttcttcctttgtactcttcagctggcacctgctccattctgccctacatgatgggtaactgtgatctttcttccctgttagattgtaagcctccgtctttgtatcccagcccctagcccagtgcctgacacaggaactgtgcacaataaaggtttatggaacagaaacaaagtcaacag

SEQ ID NO: 291329 - DNA, 423 bp, Homo sapiens
gtgaatcatctctcaacaaagtactgttaaaaaaggaaaagctcccagaggcaaagggtggcttgctttacctgccaacttggctgagacgctcctgctttggggatgctcctggctttcatgcttgtctttccaaacagtcggaagaggacattaatgttgcagctcttggcaagcagcagcctgagaatatctcgaaccccttgtatgagagcacaacctcagctcccccagaaccttcctacgaccccttcacggtgagtttgcattcttatctaggaataggttcccttggggtacaggggaatgatgtcttttaggaaatttcagtggagatctttgtaccaaagaaggttcatttctagaatgtatgtcaggtaacaagcctaaaagccagttttgcaagctgactgaagccagtgt

SEQ ID NO: 291330 - DNA, 442 bp, Homo sapiens
atctaaaggttggtaaattttattatatgtgaatcatctctcaacaaagtactgttaaaaaaggaaaagctcccagaggcaaagggtggcttgctttacctgccaacttggctgagacgctcctgctttggggatgctcctggctttcatgcttgtctttccaaacagtcggaagaggacattaatgttgcagctcttggcaagcagcagcctgagaatatctcgaaccccttgtatgagagcacaacctcagctcccccagaaccttcctacgaccccttcacggtgagtttgcattcttatctaggaataggttcccttggggtacaggggaatgatgtcttttaggaaatttcagtggagatctttgtaccaaagaaggttcatttctagaatgtatgtcaggtaacaagcctaaaagccagttttgcaagctgactga

SEQ ID NO: 291331 - DNA, 444 bp, Homo sapiens
ttttgtggtataaagttttaattgatagcccctaaagaacattttttctcatataaatctcaatgacattgcagagatcatgtcttactataaaagagtaattctagaatcccagaatctccaaggctagaaaagaccttagcaaatcaccccatcttcctgctgtacaggggcacttatgaacacagtggtcgtccagagagagtcttggaaagtctccttagatgggttttaactcttcacaccatgggtacagaatgaaagtggcccctttctttgcagttttgcctgcagtgtgtacgcctccttgttctgctcatgccacctgtaaggagaacaacacgtgtgagtgtaacctggattatgaaggtgacggaatcacatgcacaggtaagccacctttgtgcacaggtgaaatagcagcatggtgtgggagaggagcag

SEQ ID NO: 291332 - DNA, 4469 bp, Homo sapiens
  misc_feature (2)..(2): n is a, c, g, or t
  misc_feature (572)..(572): n is a, c, g, or t
ancaatataatctggcgaatgcaattgaggctgccgatgcctacacagtgtttgctccaaacaacaatgccatcgagaattacatcagggagaagaaagtcttgtctctagaggaggacgtcctccggtatcatgtggtcctggaggagaaactcctgaagaatgacctgcacaatggcatgcatcgtgagaccatgctgggtttctcctatttccttagcttctttctccataatgaccagctctatgtaaatgaggctccaataaactacaccaatgtagccactgataagggagtgatccatggcttgggaaaagttctggaaattcagaagaacagatgtgataataatgacactactattatacgaggaagatgtaggacatgctcctcagagctgacctgcccattcggaactaaatctctaggtaatgagaagaggagatgcatctatacctcctatttcatgggaagacgaaccctgtttattgggtgccagccaaaatgtgtgagaaccgtcattacgagagaatgctgtgccggcttctttggcccccaatgccagccctgnccagggaatgcccagaatgtctgctttggtaatggcatctgtttggatggagtgaatggcacaggtgtgtgtgagtgtggggagggcttcagcggcacagcctgcgagacctgcaccgagggcaagtacggcatccactgtgaccaagcatgttcttgtgtccatgggagatgcaaccaaggacccttgggagatggctcctgtgactgtgatgttggctggcgaggagtgcattgtgacaatgcaaccacagaagacaactgcaatgggacatgccataccagcgccaactgcctcaccaactcagatggtacagcttcatgcaagtgtgcagcaggattccaaggaaacgggaccatctgcacagcaatcaatgcctgtgagatcagcaatggaggttgctctgccaaggctgactgtaagagaaccaccccaggaaggcgagtgtgcacgtgcaaagcaggctacacgggtgatggcattgtgtgcctggaaatcaacccgtgtttggagaaccatggtggctgtgacaagaatgcggagtgcacacagacaggacccaaccaggctgcctgtaactgtttgccagcatacactggagatggaaaggtctgcacactcatcaatgtctgcttaactaaaaatggcggctgtagtgaatttgccatctgcaaccacactgggcaagtagaaaggacttgtacttgcaagccaaactacattggagatggatttacctgccgcggcagcatttatcaggagcttcccaagaacccgaaaacttcccagtatttcttccagttgcaggagcatttcgtgaaagatctggtcggcccaggccccttcactgtttttgcacctttatctgcagcctttgatgaggaagctcgggttaaagactgggacaaatacggtttaatgccccaggttcttcggtaccatgtggtcgcctgccaccagctgcttctggaaaacctgaaattgatctcaaatgctacttccctccaaggagagccaatagtcatctccgtctctcagagcacggtgtatataaataataaggctaagatcatatccagtgatatcatcagtactaatgggattgttcatatcatagacaaattgctatctcccaaaaatttgcttatcactcccaaagacaactctggaagaattctgcaaaatcttacgactttggcaacaaacaatggctacatcaaatttagcaacttaatacaggactcaggtttgctgagtgtcatcaccgatcccatccacaccccagtcactctcttctggcccaccgaccaagccctccatgccctacctgctgaacaacaggacttcctgttcaaccaagacaacaaggacaagctgaaggagtatttgaagtttcatgtgatacgagatgccaaggttttagctgtggatcttcccacatccactgcctggaagaccctgcaaggttcagagctgagtgtgaaatgtggagctggcagggacatcggtgacctctttctgaatggccaaacctgcagaattgtgcagcgggagctcttgtttgacctgggtgtggcctacggcattgactgtctgctgattgatcccaccctggggggccgctgtgacacctttactactttcgatgcctcgggggagtgtgggagctgtgtcaatactcccagctgcccaaggtggagtaaaccaaagggtgtgaagcagaagtgtctctacaacctgcccttcaagaggaacctggaaggctgccgggagcggtgcagcctggtgatacagatccccaggtgctgcaagggctacttcgggcgagactgtcaggcctgccctggaggaccagatgccccgtgtaataaccggggtgtctgccttgatcagtactcggccaccggagagtgtaaatgcaacaccggcttcaatgggacggcgtgtgagatgtgctggccggggagattcgggcctgattgtctgccctgtggctgctcagaccacggacagtgcgatgatggcatcacgggctccgggcagtgcctctgtgaaacggggtggacaggcccctcgtgtgacactcaggcagttttgcctgcagtgtgtacgcctccttgttctgctcatgccacctgtaaggagaacaacacgtgtgagtgtaacctggattatgaaggtgacggaatcacatgcacagttgtggatttctgcaaacaggacaacgggggctgtgcaaaggtggccagatgctcccagaagggcacgaaggtctcctgcagctgccagaagggatacaaaggggacgggcacagctgcacagagatagacccctgtgcagacggccttaacggagggtgtcacgagcacgccacctgtaagatgacaggcccgggcaagcacaagtgtgagtgtaaaagtcactatgtcggagatgggctgaactgtgagccggagcagctgcccattgaccgctgcttacaggacaatgggcagtgccatgcagacgccaaatgtgtcgacctccacttccaggataccactgttggggtgttccatctacgctccccactgggccagtataagctgacctttgacaaagccagagaggcctgtgccaacgaagctgcgaccatggcaacctacaaccagctctcctatgcccagaaggccaagtaccacctgtgctcagcaggctggctggagaccgggcgggttgcctaccccacagccttcgcctcccagaactgtggctctggtgtggttgggatagtggactatggacctagacccaacaagagtgaaatgtgggatgtcttctgctatcggatgaaaggaagtgctggcctattccaacagctcagctcgaggccgtgcatttctagaacacctgactgacctgtccatccgcggcaccctctttgtgccacagaacagtgggctgggggagaatgagaccttgtctgggcgggacatcgagcaccacctcgccaatgtcagcatgtttttctacaatgaccttgtcaatggcaccaccctgcaaacgaggctgggaagcaagctgctcatcactgccagccaggacccactccaaccgacggagaccaggtttgttgatggaagagccattctgcagtgggacatctttgcctccaatgggatcattcatgtcatttccaggcctttaaaagcaccccctgcccccgtgaccttgacccacactggcttgggagcagggatcttctttgccatcatcctggtgactggggctgttgccttggctgcttactcctactttcggataaaccggagaacaatcggcttccagcattttgagtcggaagaggacattaatgttgcagctcttggcaagcagcagcctgagaatatctcgaaccccttgtatgagagcacaacctcagctcccccagaaccttcctacgaccccttcacggactctgaagaacggcagcttgagggcaatgaccccttgaggacactgtgagggcctggacgggagatgccagccatcactcactgccacctgggcccatcaactgtgaattctcagcaccagttgccttttaggaacgtaaagtcctttaagcactcagaagccatacctcatctctctggctgatctgggggttgtttctgtgggtgagagatgtgttgctgtgcccacccagtacagcttcctcctctgaccctttggctcttcttcctttgtactcttcagctggcacctgctccattctgccctacatgatgggtaactgtgatctttcttccctgttagattgtaagcctccgtctttgtatcccagcccctagcccagtgcctgacacaggaactgtgcacaataaaggtttatggaacagaaacaaagtcaacag

SEQ ID NO: 291333 - DNA, 2191 bp, Homo sapiens
tgtggtataaagttttaattgatagcccctaaagaacattttttctcatataaatctcaatgacattgcagagatcatgtcttactataaaagagtaattctagaatcccagaatctccaaggctagaaaagaccttagcaaatcaccccatcttcctgctgtacaggggcacttatgaacacagtggtcgtccagagagagtcttggaaagtctccttagatgggttttaactcttcacaccatgggtacagaatgaaagtggcccctttctttgcagttttgcctgcagtgtgtacgcctccttgttctgctcatgccacctgtaaggagaacaacacgtgtgagtgtaacctggattatgaaggtgacggaatcacatgcacagttgtggatttctgcaaacaggacaacgggggctgtgcaaaggtggccagatgctcccagaagggcacgaaggtctcctgcagctgccagaagggatacaaaggggacgggcacagctgcacagagatagacccctgtgcagacggccttaacggagggtgtcacgagcacgccacctgtaagatgacaggcccgggcaagcacaagtgtgagtgtaaaagtcactatgtcggagatgggctgaactgtgagccggagcagctgcccattgaccgctgcttacaggacaatgggcagtgccatgcagacgccaaatgtgtcgacctccacttccaggataccactgttggggtgttccatctacgctccccactgggccagtataagctgacctttgacaaagccagagaggcctgtgccaacgaagctgcgaccatggcaacctacaaccagctctcctatgcccagaaggccaagtaccacctgtgctcagcaggctggctggagaccgggcgggttgcctaccccacagccttcgcctcccagaactgtggctctggtgtggttgggatagtggactatggacctagacccaacaagagtgaaatgtgggatgtcttctgctatcggatgaaagatgtgaactgcacctgcaaggtgggctatgtgggagatggcttctcatgcagtgggaacctgctgcaggtcctgatgtccttcccctcactcacaaacttcctgacggaagtgctggcctattccaacagctcagctcgaggccgtgcatttctagaacacctgactgacctgtccatccgcggcaccctctttgtgccacagaacagtgggctgggggagaatgagaccttgtctgggcgggacatcgagcaccacctcgccaatgtcagcatgtttttctacaatgaccttgtcaatggcaccaccctgcaaacgaggctgggaagcaagctgctcatcactgccagccaggacccactccaaccgacggagaccaggtttgttgatggaagagccattctgcagtgggacatctttgcctccaatgggatcattcatgtcatttccaggcctttaaaagcaccccctgcccccgtgaccttgacccacactggcttgggagcagggatcttctttgccatcatcctggtgactggggctgttgccttggctgcttactcctactttcggataaaccggagaacaatcggcttccagcattttgagtcggaagaggacattaatgttgcagctcttggcaagcagcagcctgagaatatctcgaaccccttgtatgagagcacaacctcagctcccccagaaccttcctacgaccccttcacggactctgaagaacggcagcttgagggcaatgaccccttgaggacactgtgagggcctggacgggagatgccagccatcactcactgccacctgggcccatcaactgtgaattctcagcaccagttgccttttaggaacgtaaagtcctttaagcactcagaagccatacctcatctctctggctgatctgggggttgtttctgtgggtgagagatgtgttgctgtgcccacccagtacagcttcctcctctgaccctttggctcttcttcctttgtactcttcagctggcacctgctccattctgccctacatgatgggtaactgtgatctttcttccctgttagattgtaagcctccgtctttgtatcccagcccctagcccagtgcctgacacaggaactgtgcacaataaaggtttatggaacagaaacaaagtcaacag

SEQ ID NO: 291334 - DNA, 757 bp, Homo sapiens
  misc_feature (2)..(2): n is a, c, g, or t
  misc_feature (572)..(572): n is a, c, g, or t
ancaatataatctggcgaatgcaattgaggctgccgatgcctacacagtgtttgctccaaacaacaatgccatcgagaattacatcagggagaagaaagtcttgtctctagaggaggacgtcctccggtatcatgtggtcctggaggagaaactcctgaagaatgacctgcacaatggcatgcatcgtgagaccatgctgggtttctcctatttccttagcttctttctccataatgaccagctctatgtaaatgaggctccaataaactacaccaatgtagccactgataagggagtgatccatggcttgggaaaagttctggaaattcagaagaacagatgtgataataatgacactactattatacgaggaagatgtaggacatgctcctcagagctgacctgcccattcggaactaaatctctaggtaatgagaagaggagatgcatctatacctcctatttcatgggaagacgaaccctgtttattgggtgccagccaaaatgtgtgagaaccgtcattacgagagaatgctgtgccggcttctttggcccccaatgccagccctgnccagggaatgcccagaatgtctgctttggtaatggcatctgtttggatggagtgaatggcacaggtgtgtgtgagtgtggggagggcttcagcggcacagcctgcgagacctgcaccgagggcaagtacggcatccactgtgaccaaggtgagcaccgtcctctccacagaggatcttgggctgc

SEQ ID NO: 291335 - DNA, 1180 bp, Homo sapiens
caatgatcaatgcaacagcaaataagaatctctagaacctaaatacctttttttttgctagactcagccaatttttcaagaaaccctattaccttttaatgtttccttcaatgagatcaagagctaatactttttctttgttcaatttcagagatcaatagctattcaaaagtagcacaccaaaaaggcgacagggtttcctgaaaaattagccagttctaggtgtaatggttagaaatgtacaaattaatcctagaatgacttgtcttaccatatagcaaagaagtcactaaggattaattgatcaaagatgagacaatttgagcatcaataagaaaaataactacaatggactgaaacacataccttttaaatccacagctcattaagaatgggactaaaaaggccaggcgtggtggctcacgcctgtaatgccagcactttgggagggtgaggcaggtggatcacctgaggtcgggagctcgagaccagcctgaccaacatggcgaaaccccatctctactaaaaatacaaaattggccgggcatgttggcacatgcctgtaatctcagctactcaggaggctgaggcaggagaatcgcttgaacctgggaggcagaggttgccgtgagccaagatcaggccattgcactccagcctgggtgacagagcgagactccctctcaaacaaacaaaaaaaagaaaacattgttcctttccacttaatactaaaggaaagaaggatcaagtttttgctctattacattcctacatacaaaatccttaaaaatgtagatttttgtctgataagttattttttaaatcaatatcaggaaaacaaatattatacagtgatgacattaaaaatactatgtaaaaaattagtattttaagccatttatttaccaattttgcatttttttctggatgaaagatttcaaacatgtcccagttttcacatcataaagttgtaggttgggtatcccagctgtgccatctttagaagctgcaataaaatttctttttttcagtaattgccttgtaacatttgtaaagggattatttttcttatttattaagtttgatatggattactatcaaatgggttaaatcatgaaagcttgcctctgtgttaccaaaataaataaataaataaatgaaaggttacataacccactca

SEQ ID NO: 291336 - DNA, 1173 bp, Homo sapiens
gtagtcctttgttacatgcatgagtcagtgaacagggaatgggtgaatgacatttgtgggtaggttatttctagaagttaggtgggcagctcggaaggcagatgcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagatagacacacttatcttggtttg

SEQ ID NO: 291337 - DNA, 723 bp, Homo sapiens
  misc_feature (2)..(2): n is a, c, g, or t
  misc_feature (5)..(5): n is a, c, g, or t
  misc_feature (7)..(8): n is a, c, g, or t
  misc_feature (10)..(13): n is a, c, g, or t
  misc_feature (18)..(18): n is a, c, g, or t
  misc_feature (21)..(21): n is a, c, g, or t
gncancnntnnnnacctncanagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagatagacacacttatcttggtttg

SEQ ID NO: 291338 - DNA, 1614 bp, Homo sapiens
tattcaaatttccaaacctgggattcttttccacaagtggaggtaataattgtcaattcacaggtgattatgatttaaagagattacttttgaagagttcctaacacattcagtcaacatttaatgatgcttcaggcactgtgttcattgctagtgagcgtatgacacacacagccatacggtcacagagctttcaatgaaaagtagcataattgctcatttcaccaggcccccggcttggggcgccttccttccccatggcgggacacctggcttcggatttcgccttctcgccccctccaggcggtgggggtgatgggccatgggggcggagccgggctgggttgatcctctgacctggctaagcttccaaggccctcctggagggccaggaatcgggccgggggttgggccaggctctgaggtgtgggggattcccccttgccccccgccgtatgagttatgtggggggatggcgtactgtgggcctcaggttggagtggggctagtgccccaaggcggcttggagacctctcagcctgagggcgaagcaggagtcggggtggagaagcaactccgatggggcctccccggagccctgcaccgtcacccctggtgccgtgaagctggagaaggagaagctggagcaaaacccggagaagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagatagacacacttatcttggtttg

SEQ ID NO: 291339 - DNA, 844 bp, Homo sapiens
acgagcgtagcttccttgtcgtgtggcctcagtccttcgccgtccctcgccgtccttcgccatcgcacgccaccgcaccccatctctcgaaatctgcagacatcttgatttttcccacgctgtctgtcaggtctccgccgccactcgacgccagggcgccgggccttgtgggctgtgctgcacctcggacggcttcgcaccagccagcgccctctctctcctgcagcactctgatctgcaccccctgaggggcttccactgtccgcggggtgagaatgcccctgggagtgtcacatgactgccgccccatgtgtgtgagaggcgtcctctgggagagcatggatcctgaggtcccaggattgtcagctgacctctgtcctgtgtgcccagtggccccaggtgacgtgtcttcaagaagaggctgagctgcggtgcttgtaaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291340 - DNA, 994 bp, Homo sapiens
acgagcgtagcttccttgtcgtgtggcctcagtccttcgccgtccctcgccgtccttcgccatcgcacgccaccgcaccccatctctcgaaatctgcagacatcttgatttttcccacgctgtctgtcaggtctccgccgccactcgacgccagggcgccgggccttgtgggctgtgctgcacctcggacggcttcgcaccagccagcgccctctctctcctgcagcactctgatctgcaccccctgaggggcttccactgtccgcggggtgagaatgcccctgggagtgtcacatgactgccgccccatgtgtgtgagaggcgtcctctgggagagcatggatcctgaggtcccaggattgtcagctgacctctgtcctgtgtgcccagtggccccaggtgacgtgtcttcaagaagaggctgagctgcggtgcttgtaagagtcatgtgctgttcctggggcttggatgatgtaggggaagcaaggtgaaagtggtatcccgtggttccacgttctgtcctgctgtggggctgtccctcacatgctttcagtggctgttgcagaggaagagcctccggaaatctgcgtgggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291341 - DNA, 2189 bp, Homo sapiens
acgagcgtagcttccttgtcgtgtggcctcagtccttcgccgtccctcgccgtccttcgccatcgcacgccaccgcaccccatctctcgaaatctgcagacatcttgatttttcccacgctgtctgtcaggtctccgccgccactcgacgccagggcgccgggccttgtgggctgtgctgcacctcggacggcttcgcaccagccagcgccctctctctcctgcagcactctgatctgcaccccctgaggggcttccactgtccgcggggtgagaatgcccctgggagtgtcacatgactgccgccccatgtgtgtgagaggcgtcctctgggagagcatggatcctgaggtcccaggaacatcccgagagccaagttcccagatgccagccaagggccatctgacctgttttgaatctcaatttcctgatacagaaaacaaaggattgtcagctgacctctgtcctgtgtgcccagtggccccaggtgacgtgtcttcaagaagaggctgagctgcggtgcttgtaaggggtctcattctgtcacccaggctggagtgcagtggtgcaatgatggctcactgcagcctcgacctgggctcaagtgatcctccacctcagcttcctgagtagctgggaccacagagtcatgtgctgttcctggggcttggatgatgtaggggaagcaaggtgaaagtggtatcccgtggttccacgttctgtcctgctgtggggctgtccctcacatgctttcagtggctgttgcagaggaagagcctccggaaatctgcgtgggtaaagtgagctccccgggggaaccgtcctcctcccttgagcgctggtgtgtccatagtgtgctgtgatctggattagcagtgagtttttctttcagggtgtgtgtgtatgatgttaggaccatatgctcctgaccttttccaacccaaaagcgtttccatttttttaatgctggaagtgtcttaactccttttggggtcttagaaggacacacggtggccgtggctgggcctctgctcagctgggctgctctccctgcctcaggcccttgacaccagcctccctcccttgctggctctctttctgtccttccctgctcttgtatccaaaagtgatcatgggttgcctgtgtcccgatcattaacagtgcaggggtaggagtgctgaaagacatcttccctgcgttggtccagccttccctttcaaaccctggagctttcccacgctgcagcctttttccaactaggctttcagagcttgggcctttgtgggcccatgtgatgtggtgactagacccaccccctgacttctgagggttcattttgtcttttcatgttagggatcctcctgccagaaaccagtctgcatttctctctgggccccacgctggaatgaattcagatagcagtgaagggcacacgtgagaactgcgaatcacgggctttgcttcatgaaatgtgaaatccacattgtttccacaggcaccatcagtaatgtcgaacaaatggagaaagttgcaggtggggctaggaaagctgtattcctgtggattactctagctggtcatttgccccgattgtgaactgcttgaaagaaaaacgaaacttctaagatgtttgtcctttcatgtcctttctgttgggattttttatttggtgtgcgtgaatgaggagcttcgccctgcttgaatgggacccctctcagtggtgtcagcttggggaggaggagatggccctggagactaaatacttgtatgctttcttaccctcttaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291342 - DNA, 2611 bp, Homo sapiens
gcccctgcattcgaaagtgatcatgagctgcccgtgccctggtcattggtagtgcagggagaggaactgccgagagcacttccccgtgtttggagggtccactcctgtctcttccaaaccctggagctttcccacacctcctccctcccaccacgtcttagatggctcctggtgcctggcatcatctagtgggttgtgttgctcttctccctggcccagggcagttattgtgagacatgagggaagggtgtggggtgatgggtttggcctcatggagcagaagggctgggtgtggagctgagatagggctgccctgctccttcctcccggaagctttctctgcctccacacctctccttccacgtccttatccagcccctgcaccaagctgaacctgtggaaattgttgcctgacttgtttcctggctctctttgctgtggtctcaagggcagtgtctgaattttgttccctactttgttatgtctgccagatggtcagtattctgacagtgtgggacaaaggaaaaacggcagcctgggcaaccccgcctctataagaactaaaaaattagccaggcatggcggtgcatgcccctgtagtcctagcttctcaggaggctgaggcaggaggctctcttgagcccgggaggacaaggctgcagtgagccatgaccatgccactgcactcagcctgggcaacagagtgagaccctgtctcaagaaagaaaaacgagaaagggagagtccctccactgtaaggagatcgggttcattacattttggggtgttggagaaaaatactgagtcagcacctgtgtgggattggtgggagcagatttggtgttttccaccccttcacaggattctgaggtaactcatttctgttggccttggccttgtatggggaggatttccctccagccttgtatggggaggatttcccttgtatggggaggattttccctccagcttgtgggaaaggaatcaaggaccagagacaggcaggggagaagatcactgagggatttacggcagcagcctctgcacggcttccccacgacctccccagctgcttgctggacgctgctggagaaacagcacatcccaagatcatcatggccccagcatcctcttgaacttagtaacagttggcctgacagatgaagcggatatcatccctgccttagaagttctctagcccctttcttagagataagctgctatttcattcctaaaagaagtcatggctgttcaggtgagaagaacggtttagtcagcatctatgcaacactgtagagatgcttagtgagaggtgttgcaggagagtggcagaccgcagggcccgaggtaaggtttcttgtccatctctggaattttggctttttgcaccctgtaaagtcacgtcccctttttttctggtgctttggtggtgacgtagggagaggtgaggatgagaagaggagccatgtcctatggattcccagatccagactcctcttccctgggaaagctggattggagctggcccctccttctgtgccttcgggctgtggaggaggaggcccctgcagggagctgcctggggcgagcgctgggggcttttcctgcagtgcattagcagcatgtcataatggaaagtggctggatttctttccagttgtaatcaatggttaagatttaacctagcaacattgtaggggtacacagccaaatgattcaggaaaaaagatgcaggttgagtctggaggaatccctgtgccagcttcctcatgctccctccctctctcagaaatcacatggaacccattctcccctcagcagtgaaaatgcattcagcctgtgtgcagtgtttctgcccagggaagcccagtagggcctccatgcccggggtgtttactgggatctggttatgtagacaccacctgcctagcacgcaccaaaattccagactttcaggaaaacaggtgcctgtgccacattatttgcacggagagactgtgtccagtgaacggttctgatcagtaaactgttgactaggaacatcccgagagccaagttcccagatgccagccaagggccatctgacctgttttgaatctcaatttcctgatacagaaaacaaaggattgtcagctgacctctgtcctgtgtgcccagtggccccaggtgacgtgtcttcaagaagaggctgagctgcggtgcttgtaaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291343 - DNA, 959 bp, Homo sapiens
acgagcgtagcttccttgtcgtgtggcctcagtccttcgccgtccctcgccgtccttcgccatcgcacgccaccgcaccccatctctcgaaatctgcagacatcttgatttttcccacgctgtctgtcaggtctccgccgccactcgacgccagggcgccgggccttgtgggctgtgctgcacctcggacggcttcgcaccagccagcgccctctctctcctgcagcactctgatctgcaccccctgaggggcttccactgtccgcggggtgagaatgcccctgggagtgtcacatgactgccgccccatgtgtgtgagaggcgtcctctgggagagcatggatcctgaggtcccaggattgtcagctgacctctgtcctgtgtgcccagtggccccaggtgacgtgtcttcaagaagaggctgagctgcggtgcttgtaaggggtctcattctgtcacccaggctggagtgcagtggtgcaatgatggctcactgcagcctcgacctgggctcaagtgatcctccacctcagcttcctgagtagctgggaccacaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291344 - DNA, 908 bp, Homo sapiens
  misc_feature (855)..(855): n is a, c, g, or t
  misc_feature (861)..(861): n is a, c, g, or t
  misc_feature (880)..(880): n is a, c, g, or t
acgagcgtagcttccttgtcgtgtggcctcagtccttcgccgtccctcgccgtccttcgccatcgcacgccaccgcaccccatctctcgaaatctgcagacatcttgatttttcccacgctgtctgtcaggtctccgccgccactcgacgccagggcgccgggccttgtgggctgtgctgcacctcggacggcttcgcaccagccagcgccctctctctcctgcagcactctgatctgcaccccctgaggggcttccactgtccgcggggtgagaatgcccctgggagtgtcacatgactgccgccccatgtgtgtgagaggcgtcctctgggagagcatggatcctgaggtcccaggattgtcagctgacctctgtcctgtgtgcccagtggccccaggtgacgtgtcttcaagaagaggctgagctgcggtgcttgtaaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgcaaaaaaaaaanggcggngcaaaaacccagggccaantacgtacagttctgacaagggccatagg

SEQ ID NO: 291345 - DNA, 1164 bp, Homo sapiens
acgagcgtagcttccttgtcgtgtggcctcagtccttcgccgtccctcgccgtccttcgccatcgcacgccaccgcaccccatctctcgaaatctgcagacatcttgatttttcccacgctgtctgtcaggtctccgccgccactcgacgccagggcgccgggtgagtccacagcagggcgcatggtcggctccactctcaccatcgggggaaactgaggccccggggaaggcggccagagaggtcaggccctgtccttggtgcagtgtctcgtcctctttgccggagtgagccccccaggattcgcgtgtcctcgggaaagacactggcaggccttgtgggctgtgctgcacctcggacggcttcgcaccagccagcgccctctctctcctgcagcactctgatctgcaccccctgaggggcttccactgtccgcggggtgagaatgcccctgggagtgtcacatgactgccgccccatgtgtgtgagaggcgtcctctgggagagcatggatcctgaggtcccaggattgtcagctgacctctgtcctgtgtgcccagtggccccaggtgacgtgtcttcaagaagaggctgagctgcggtgcttgtaagagtcatgtgctgttcctggggcttggatgatgtaggggaagcaaggtgaaagtggtatcccgtggttccacgttctgtcctgctgtggggctgtccctcacatgctttcagtggctgttgcagaggaagagcctccggaaatctgcgtgggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291346 - DNA, 3996 bp, Homo sapiens
gcccctgcattcgaaagtgatcatgagctgcccgtgccctggtcattggtagtgcagggagaggaactgccgagagcacttccccgtgtttggagggtccactcctgtctcttccaaaccctggagctttcccacacctcctccctcccaccacgtcttagatggctcctggtgcctggcatcatctagtgggttgtgttgctcttctccctggcccagggcagttattgtgagacatgagggaagggtgtggggtgatgggtttggcctcatggagcagaagggctgggtgtggagctgagatagggctgccctgctccttcctcccggaagctttctctgcctccacacctctccttccacgtccttatccagcccctgcaccaagctgaacctgtggaaattgttgcctgacttgtttcctggctctctttgctgtggtctcaagggcagtgtctgaattttgttccctactttgttatgtctgccagatggtcagtattctgacagtgtgggacaaaggaaaaacggcagcctgggcaaccccgcctctataagaactaaaaaattagccaggcatggcggtgcatgcccctgtagtcctagcttctcaggaggctgaggcaggaggctctcttgagcccgggaggacaaggctgcagtgagccatgaccatgccactgcactcagcctgggcaacagagtgagaccctgtctcaagaaagaaaaacgagaaagggagagtccctccactgtaaggagatcgggttcattacattttggggtgttggagaaaaatactgagtcagcacctgtgtgggattggtgggagcagatttggtgttttccaccccttcacaggattctgaggtaactcatttctgttggccttggccttgtatggggaggatttccctccagccttgtatggggaggatttcccttgtatggggaggattttccctccagcttgtgggaaaggaatcaaggaccagagacaggcaggggagaagatcactgagggatttacggcagcagcctctgcacggcttccccacgacctccccagctgcttgctggacgctgctggagaaacagcacatcccaagatcatcatggccccagcatcctcttgaacttagtaacagttggcctgacagatgaagcggatatcatccctgccttagaagttctctagcccctttcttagagataagctgctatttcattcctaaaagaagtcatggctgttcaggtgagaagaacggtttagtcagcatctatgcaacactgtagagatgcttagtgagaggtgttgcaggagagtggcagaccgcagggcccgaggtaaggtttcttgtccatctctggaattttggctttttgcaccctgtaaagtcacgtcccctttttttctggtgctttggtggtgacgtagggagaggtgaggatgagaagaggagccatgtcctatggattcccagatccagactcctcttccctgggaaagctggattggagctggcccctccttctgtgccttcgggctgtggaggaggaggcccctgcagggagctgcctggggcgagcgctgggggcttttcctgcagtgcattagcagcatgtcataatggaaagtggctggatttctttccagttgtaatcaatggttaagatttaacctagcaacattgtaggggtacacagccaaatgattcaggaaaaaagatgcaggttgagtctggaggaatccctgtgccagcttcctcatgctccctccctctctcagaaatcacatggaacccattctcccctcagcagtgaaaatgcattcagcctgtgtgcagtgtttctgcccagggaagcccagtagggcctccatgcccggggtgtttactgggatctggttatgtagacaccacctgcctagcacgcaccaaaattccagactttcaggaaaacaggtgcctgtgccacattatttgcacggagagactgtgtccagtgaacggttctgatcagtaaactgttgactaggaacatcccgagagccaagttcccagatgccagccaagggccatctgacctgttttgaatctcaatttcctgatacagaaaacaaaggattgtcagctgacctctgtcctgtgtgcccagtggccccaggtgacgtgtcttcaagaagaggctgagctgcggtgcttgtaaggggtctcattctgtcacccaggctggagtgcagtggtgcaatgatggctcactgcagcctcgacctgggctcaagtgatcctccacctcagcttcctgagtagctgggaccacagatgggtccgctgtgtgcagaggctccatgggatgtgttgtcttcatagtagcaggtcgctggaccatgggtccgcaaggtgggatttttggactgttgtctggaatatgtttctttgcatcctgcagagtcatgtgctgttcctggggcttggatgatgtaggggaagcaaggtgaaagtggtatcccgtggttccacgttctgtcctgctgtggggctgtccctcacatgctttcagtggctgttgcagaggaagagcctccggaaatctgcgtgggtaaagtgagctccccgggggaaccgtcctcctcccttgagcgctggtgtgtccatagtgtgctgtgatctggattagcagtgagtttttctttcagggtgtgtgtgtatgatgttaggaccatatgctcctgaccttttccaacccaaaagcgtttccatttttttaatgctggaagtgtcttaactccttttggggtcttagaaggacacacggtggccgtggctgggcctctgctcagctgggctgctctccctgcctcaggcccttgacaccagcctccctcccttgctggctctctttctgtccttccctgctcttgtatccaaaagtgatcatgggttgcctgtgtcccgatcattaacagtgcaggggtaggagtgctgaaagacatcttccctgcgttggtccagccttccctttcaaaccctggagctttcccacgctgcagcctttttccaactaggctttcagagcttgggcctttgtgggcccatgtgatgtggtgactagacccaccccctgacttctgagggttcattttgtcttttcatgttagggatcctcctgccagaaaccagtctgcatttctctctgggccccacgctggaatgaattcagatagcagtgaagggcacacgtgagaactgcgaatcacgggctttgcttcatgaaatgtgaaatccacattgtttccacaggcaccatcagtaatgtcgaacaaatggagaaagttgcaggtggggctaggaaagctgtattcctgtggattactctagctggtcatttgccccgattgtgaactgcttgaaagaaaaacgaaacttctaagatgtttgtcctttcatgtcctttctgttgggattttttatttggtgtgcgtgaatgaggagcttcgccctgcttgaatgggacccctctcagtggtgtcagcttggggaggaggagatggccctggagactaaatacttgtatgctttcttaccctcttaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291347 - DNA, 1014 bp, Homo sapiens
acgagcgtagcttccttgtcgtgtggcctcagtccttcgccgtccctcgccgtccttcgccatcgcacgccaccgcaccccatctctcgaaatctgcagacatcttgatttttcccacgctgtctgtcaggtctccgccgccactcgacgccagggcgccgggtgagtccacagcagggcgcatggtcggctccactctcaccatcgggggaaactgaggccccggggaaggcggccagagaggtcaggccctgtccttggtgcagtgtctcgtcctctttgccggagtgagccccccaggattcgcgtgtcctcgggaaagacactggcaggccttgtgggctgtgctgcacctcggacggcttcgcaccagccagcgccctctctctcctgcagcactctgatctgcaccccctgaggggcttccactgtccgcggggtgagaatgcccctgggagtgtcacatgactgccgccccatgtgtgtgagaggcgtcctctgggagagcatggatcctgaggtcccaggattgtcagctgacctctgtcctgtgtgcccagtggccccaggtgacgtgtcttcaagaagaggctgagctgcggtgcttgtaaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291348 - DNA, 2102 bp, Homo sapiens
acgagcgtagcttccttgtcgtgtggcctcagtccttcgccgtccctcgccgtccttcgccatcgcacgccaccgcaccccatctctcgaaatctgcagacatcttgatttttcccacgctgtctgtcaggtctccgccgccactcgacgccagggcgccgggccttgtgggctgtgctgcacctcggacggcttcgcaccagccagcgccctctctctcctgcagcactctgatctgcaccccctgaggggcttccactgtccgcggggtgagaatgcccctgggagtgtcacatgactgccgccccatgtgtgtgagaggcgtcctctgggagagcatggatcctgaggtcccaggattgtcagctgacctctgtcctgtgtgcccagtggccccaggtgacgtgtcttcaagaagaggctgagctgcggtgcttgtaaggggtctcattctgtcacccaggctggagtgcagtggtgcaatgatggctcactgcagcctcgacctgggctcaagtgatcctccacctcagcttcctgagtagctgggaccacagagtcatgtgctgttcctggggcttggatgatgtaggggaagcaaggtgaaagtggtatcccgtggttccacgttctgtcctgctgtggggctgtccctcacatgctttcagtggctgttgcagaggaagagcctccggaaatctgcgtgggtaaagtgagctccccgggggaaccgtcctcctcccttgagcgctggtgtgtccatagtgtgctgtgatctggattagcagtgagtttttctttcagggtgtgtgtgtatgatgttaggaccatatgctcctgaccttttccaacccaaaagcgtttccatttttttaatgctggaagtgtcttaactccttttggggtcttagaaggacacacggtggccgtggctgggcctctgctcagctgggctgctctccctgcctcaggcccttgacaccagcctccctcccttgctggctctctttctgtccttccctgctcttgtatccaaaagtgatcatgggttgcctgtgtcccgatcattaacagtgcaggggtaggagtgctgaaagacatcttccctgcgttggtccagccttccctttcaaaccctggagctttcccacgctgcagcctttttccaactaggctttcagagcttgggcctttgtgggcccatgtgatgtggtgactagacccaccccctgacttctgagggttcattttgtcttttcatgttagggatcctcctgccagaaaccagtctgcatttctctctgggccccacgctggaatgaattcagatagcagtgaagggcacacgtgagaactgcgaatcacgggctttgcttcatgaaatgtgaaatccacattgtttccacaggcaccatcagtaatgtcgaacaaatggagaaagttgcaggtggggctaggaaagctgtattcctgtggattactctagctggtcatttgccccgattgtgaactgcttgaaagaaaaacgaaacttctaagatgtttgtcctttcatgtcctttctgttgggattttttatttggtgtgcgtgaatgaggagcttcgccctgcttgaatgggacccctctcagtggtgtcagcttggggaggaggagatggccctggagactaaatacttgtatgctttcttaccctcttaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291349 - DNA, 2085 bp, Homo sapiens
acgagcgtagcttccttgtcgtgtggcctcagtccttcgccgtccctcgccgtccttcgccatcgcacgccaccgcaccccatctctcgaaatctgcagacatcttgatttttcccacgctgtctgtcaggtctccgccgccactcgacgccagggcgccgggtgagtccacagcagggcgcatggtcggctccactctcaccatcgggggaaactgaggccccggggaaggcggccagagaggtcaggccctgtccttggtgcagtgtctcgtcctctttgccggagtgagccccccaggattcgcgtgtcctcgggaaagacactggcaggccttgtgggctgtgctgcacctcggacggcttcgcaccagccagcgccctctctctcctgcagcactctgatctgcaccccctgaggggcttccactgtccgcggggtgagaatgcccctgggattgtcagctgacctctgtcctgtgtgcccagtggccccaggtgacgtgtcttcaagaagaggctgagctgcggtgcttgtaagagtcatgtgctgttcctggggcttggatgatgtaggggaagcaaggtgaaagtggtatcccgtggttccacgttctgtcctgctgtggggctgtccctcacatgctttcagtggctgttgcagaggaagagcctccggaaatctgcgtgggtaaagtgagctccccgggggaaccgtcctcctcccttgagcgctggtgtgtccatagtgtgctgtgatctggattagcagtgagtttttctttcagggtgtgtgtgtatgatgttaggaccatatgctcctgaccttttccaacccaaaagcgtttccatttttttaatgctggaagtgtcttaactccttttggggtcttagaaggacacacggtggccgtggctgggcctctgctcagctgggctgctctccctgcctcaggcccttgacaccagcctccctcccttgctggctctctttctgtccttccctgctcttgtatccaaaagtgatcatgggttgcctgtgtcccgatcattaacagtgcaggggtaggagtgctgaaagacatcttccctgcgttggtccagccttccctttcaaaccctggagctttcccacgctgcagcctttttccaactaggctttcagagcttgggcctttgtgggcccatgtgatgtggtgactagacccaccccctgacttctgagggttcattttgtcttttcatgttagggatcctcctgccagaaaccagtctgcatttctctctgggccccacgctggaatgaattcagatagcagtgaagggcacacgtgagaactgcgaatcacgggctttgcttcatgaaatgtgaaatccacattgtttccacaggcaccatcagtaatgtcgaacaaatggagaaagttgcaggtggggctaggaaagctgtattcctgtggattactctagctggtcatttgccccgattgtgaactgcttgaaagaaaaacgaaacttctaagatgtttgtcctttcatgtcctttctgttgggattttttatttggtgtgcgtgaatgaggagcttcgccctgcttgaatgggacccctctcagtggtgtcagcttggggaggaggagatggccctggagactaaatacttgtatgctttcttaccctcttaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291350 - DNA, 2149 bp, Homo sapiens
acgagcgtagcttccttgtcgtgtggcctcagtccttcgccgtccctcgccgtccttcgccatcgcacgccaccgcaccccatctctcgaaatctgcagacatcttgatttttcccacgctgtctgtcaggtctccgccgccactcgacgccagggcgccgggtgagtccacagcagggcgcatggtcggctccactctcaccatcgggggaaactgaggccccggggaaggcggccagagaggtcaggccctgtccttggtgcagtgtctcgtcctctttgccggagtgagccccccaggattcgcgtgtcctcgggaaagacactggcaggagtgtcacatgactgccgccccatgtgtgtgagaggcgtcctctgggagagcatggatcctgaggtcccaggattgtcagctgacctctgtcctgtgtgcccagtggccccaggtgacgtgtcttcaagaagaggctgagctgcggtgcttgtaaggggtctcattctgtcacccaggctggagtgcagtggtgcaatgatggctcactgcagcctcgacctgggctcaagtgatcctccacctcagcttcctgagtagctgggaccacagagtcatgtgctgttcctggggcttggatgatgtaggggaagcaaggtgaaagtggtatcccgtggttccacgttctgtcctgctgtggggctgtccctcacatgctttcagtggctgttgcagaggaagagcctccggaaatctgcgtgggtaaagtgagctccccgggggaaccgtcctcctcccttgagcgctggtgtgtccatagtgtgctgtgatctggattagcagtgagtttttctttcagggtgtgtgtgtatgatgttaggaccatatgctcctgaccttttccaacccaaaagcgtttccatttttttaatgctggaagtgtcttaactccttttggggtcttagaaggacacacggtggccgtggctgggcctctgctcagctgggctgctctccctgcctcaggcccttgacaccagcctccctcccttgctggctctctttctgtccttccctgctcttgtatccaaaagtgatcatgggttgcctgtgtcccgatcattaacagtgcaggggtaggagtgctgaaagacatcttccctgcgttggtccagccttccctttcaaaccctggagctttcccacgctgcagcctttttccaactaggctttcagagcttgggcctttgtgggcccatgtgatgtggtgactagacccaccccctgacttctgagggttcattttgtcttttcatgttagggatcctcctgccagaaaccagtctgcatttctctctgggccccacgctggaatgaattcagatagcagtgaagggcacacgtgagaactgcgaatcacgggctttgcttcatgaaatgtgaaatccacattgtttccacaggcaccatcagtaatgtcgaacaaatggagaaagttgcaggtggggctaggaaagctgtattcctgtggattactctagctggtcatttgccccgattgtgaactgcttgaaagaaaaacgaaacttctaagatgtttgtcctttcatgtcctttctgttgggattttttatttggtgtgcgtgaatgaggagcttcgccctgcttgaatgggacccctctcagtggtgtcagcttggggaggaggagatggccctggagactaaatacttgtatgctttcttaccctcttaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291351 - DNA, 2049 bp, Homo sapiens
ccacattttctttttccattcatctgttgatggagacttagattgtttccgtatcttggcgattgggagtaatgccgcagtgaatattggagtgcagatgtctttatgaggtgtgatttgatctccattgagtatgtgtccagaagagggatagctgggtctatgtaatgtatactgataagcagcacagagtgggcacataggatagcatagatgccatttttctcacagatagtttgccgacctcttcctagagttacgtttttcttgttcctgagacaataatgtggctgtaagtactaatagagacagtggcatttgtgggttgcttatgatctgccagcccctgcgttaagtgttctctgtgtctgtttcagatgggtccgctgtgtgcagaggctccatgggatgtgttgtcttcatagtagcaggtcgctggaccatgggtccgcaaggtgggatttttggactgttgtctggaatatgtttctttgcatcctgcagagtcatgtgctgttcctggggcttggatgatgtaggggaagcaaggtgaaagtggtatcccgtggttccacgttctgtcctgctgtggggctgtccctcacatgctttcagtggctgttgcagaggaagagcctccggaaatctgcgtgggtaaagtgagctccccgggggaaccgtcctcctcccttgagcgctggtgtgtccatagtgtgctgtgatctggattagcagtgagtttttctttcagggtgtgtgtgtatgatgttaggaccatatgctcctgaccttttccaacccaaaagcgtttccatttttttaatgctggaagtgtcttaactccttttggggtcttagaaggacacacggtggccgtggctgggcctctgctcagctgggctgctctccctgcctcaggcccttgacaccagcctccctcccttgctggctctctttctgtccttccctgctcttgtatccaaaagtgatcatgggttgcctgtgtcccgatcattaacagtgcaggggtaggagtgctgaaagacatcttccctgcgttggtccagccttccctttcaaaccctggagctttcccacgctgcagcctttttccaactaggctttcagagcttgggcctttgtgggcccatgtgatgtggtgactagacccaccccctgacttctgagggttcattttgtcttttcatgttagggatcctcctgccagaaaccagtctgcatttctctctgggccccacgctggaatgaattcagatagcagtgaagggcacacgtgagaactgcgaatcacgggctttgcttcatgaaatgtgaaatccacattgtttccacaggcaccatcagtaatgtcgaacaaatggagaaagttgcaggtggggctaggaaagctgtattcctgtggattactctagctggtcatttgccccgattgtgaactgcttgaaagaaaaacgaaacttctaagatgtttgtcctttcatgtcctttctgttgggattttttatttggtgtgcgtgaatgaggagcttcgccctgcttgaatgggacccctctcagtggtgtcagcttggggaggaggagatggccctggagactaaatacttgtatgctttcttaccctcttaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291352 - DNA, 2804 bp, Homo sapiens
gcccctgcattcgaaagtgatcatgagctgcccgtgccctggtcattggtagtgcagggagaggaactgccgagagcacttccccgtgtttggagggtccactcctgtctcttccaaaccctggagctttcccacacctcctccctcccaccacgtcttagatggctcctggtgcctggcatcatctagtgggttgtgttgctcttctccctggcccagggcagttattgtgagacatgagggaagggtgtggggtgatgggtttggcctcatggagcagaagggctgggtgtggagctgagatagggctgccctgctccttcctcccggaagctttctctgcctccacacctctccttccacgtccttatccagcccctgcaccaagctgaacctgtggaaattgttgcctgacttgtttcctggctctctttgctgtggtctcaagggcagtgtctgaattttgttccctactttgttatgtctgccagatggtcagtattctgacagtgtgggacaaaggaaaaacggcagcctgggcaaccccgcctctataagaactaaaaaattagccaggcatggcggtgcatgcccctgtagtcctagcttctcaggaggctgaggcaggaggctctcttgagcccgggaggacaaggctgcagtgagccatgaccatgccactgcactcagcctgggcaacagagtgagaccctgtctcaagaaagaaaaacgagaaagggagagtccctccactgtaaggagatcgggttcattacattttggggtgttggagaaaaatactgagtcagcacctgtgtgggattggtgggagcagatttggtgttttccaccccttcacaggattctgaggtaactcatttctgttggccttggccttgtatggggaggatttccctccagccttgtatggggaggatttcccttgtatggggaggattttccctccagcttgtgggaaaggaatcaaggaccagagacaggcaggggagaagatcactgagggatttacggcagcagcctctgcacggcttccccacgacctccccagctgcttgctggacgctgctggagaaacagcacatcccaagatcatcatggccccagcatcctcttgaacttagtaacagttggcctgacagatgaagcggatatcatccctgccttagaagttctctagcccctttcttagagataagctgctatttcattcctaaaagaagtcatggctgttcaggtgagaagaacggtttagtcagcatctatgcaacactgtagagatgcttagtgagaggtgttgcaggagagtggcagaccgcagggcccgaggtaaggtttcttgtccatctctggaattttggctttttgcaccctgtaaagtcacgtcccctttttttctggtgctttggtggtgacgtagggagaggtgaggatgagaagaggagccatgtcctatggattcccagatccagactcctcttccctgggaaagctggattggagctggcccctccttctgtgccttcgggctgtggaggaggaggcccctgcagggagctgcctggggcgagcgctgggggcttttcctgcagtgcattagcagcatgtcataatggaaagtggctggatttctttccagttgtaatcaatggttaagatttaacctagcaacattgtaggggtacacagccaaatgattcaggaaaaaagatgcaggttgagtctggaggaatccctgtgccagcttcctcatgctccctccctctctcagaaatcacatggaacccattctcccctcagcagtgaaaatgcattcagcctgtgtgcagtgtttctgcccagggaagcccagtagggcctccatgcccggggtgtttactgggatctggttatgtagacaccacctgcctagcacgcaccaaaattccagactttcaggaaaacaggtgcctgtgccacattatttgcacggagagactgtgtccagtgaacggttctgatcagtaaactgttgactaggaacatcccgagagccaagttcccagatgccagccaagggccatctgacctgttttgaatctcaatttcctgatacagaaaacaaaggattgtcagctgacctctgtcctgtgtgcccagtggccccaggtgacgtgtcttcaagaagaggctgagctgcggtgcttgtaaggggtctcattctgtcacccaggctggagtgcagtggtgcaatgatggctcactgcagcctcgacctgggctcaagtgatcctccacctcagcttcctgagtagctgggaccacagatgggtccgctgtgtgcagaggctccatgggatgtgttgtcttcatagtagcaggtcgctggaccatgggtccgcaaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291353 - DNA, 931 bp, Homo sapiens
acgagcgtagcttccttgtcgtgtggcctcagtccttcgccgtccctcgccgtccttcgccatcgcacgccaccgcaccccatctctcgaaatctgcagacatcttgatttttcccacgctgtctgtcaggtctccgccgccactcgacgccagggcgccgggccttgtgggctgtgctgcacctcggacggcttcgcaccagccagcgccctctctctcctgcagcactctgatctgcaccccctgaggggcttccactgtccgcggggtgagaatgcccctgggagtgtcacatgactgccgccccatgtgtgtgagaggcgtcctctgggagagcatggatcctgaggtcccaggaacatcccgagagccaagttcccagatgccagccaagggccatctgacctgttttgaatctcaatttcctgatacagaaaacaaaggattgtcagctgacctctgtcctgtgtgcccagtggccccaggtgacgtgtcttcaagaagaggctgagctgcggtgcttgtaaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291354 - DNA, 922 bp, Homo sapiens
acgagcgtagcttccttgtcgtgtggcctcagtccttcgccgtccctcgccgtccttcgccatcgcacgccaccgcaccccatctctcgaaatctgcagacatcttgatttttcccacgctgtctgtcaggtctccgccgccactcgacgccagggcgccgggccttgtgggctgtgctgcacctcggacggcttcgcaccagccagcgccctctctctcctgcagcactctgatctgcaccccctgaggggcttccactgtccgcggggtgagaatgcccctgggagtgtcacatgactgccgccccatgtgtgtgagaggcgtcctctgggagagcatggatcctgaggtcccaggattgtcagctgacctctgtcctgtgtgcccagtggccccaggtgacgtgtcttcaagaagaggctgagctgcggtgcttgtaagatgggtccgctgtgtgcagaggctccatgggatgtgttgtcttcatagtagcaggtcgctggaccatgggtccgcaaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291355 - DNA, 1037 bp, Homo sapiens
acgagcgtagcttccttgtcgtgtggcctcagtccttcgccgtccctcgccgtccttcgccatcgcacgccaccgcaccccatctctcgaaatctgcagacatcttgatttttcccacgctgtctgtcaggtctccgccgccactcgacgccagggcgccgggccttgtgggctgtgctgcacctcggacggcttcgcaccagccagcgccctctctctcctgcagcactctgatctgcaccccctgaggggcttccactgtccgcggggtgagaatgcccctgggagtgtcacatgactgccgccccatgtgtgtgagaggcgtcctctgggagagcatggatcctgaggtcccaggattgtcagctgacctctgtcctgtgtgcccagtggccccaggtgacgtgtcttcaagaagaggctgagctgcggtgcttgtaaggggtctcattctgtcacccaggctggagtgcagtggtgcaatgatggctcactgcagcctcgacctgggctcaagtgatcctccacctcagcttcctgagtagctgggaccacagatgggtccgctgtgtgcagaggctccatgggatgtgttgtcttcatagtagcaggtcgctggaccatgggtccgcaaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291356 - DNA, 4101 bp, Homo sapiens
gcccctgcattcgaaagtgatcatgagctgcccgtgccctggtcattggtagtgcagggagaggaactgccgagagcacttccccgtgtttggagggtccactcctgtctcttccaaaccctggagctttcccacacctcctccctcccaccacgtcttagatggctcctggtgcctggcatcatctagtgggttgtgttgctcttctccctggcccagggcagttattgtgagacatgagggaagggtgtggggtgatgggtttggcctcatggagcagaagggctgggtgtggagctgagatagggctgccctgctccttcctcccggaagctttctctgcctccacacctctccttccacgtccttatccagcccctgcaccaagctgaacctgtggaaattgttgcctgacttgtttcctggctctctttgctgtggtctcaagggcagtgtctgaattttgttccctactttgttatgtctgccagatggtcagtattctgacagtgtgggacaaaggaaaaacggcagcctgggcaaccccgcctctataagaactaaaaaattagccaggcatggcggtgcatgcccctgtagtcctagcttctcaggaggctgaggcaggaggctctcttgagcccgggaggacaaggctgcagtgagccatgaccatgccactgcactcagcctgggcaacagagtgagaccctgtctcaagaaagaaaaacgagaaagggagagtccctccactgtaaggagatcgggttcattacattttggggtgttggagaaaaatactgagtcagcacctgtgtgggattggtgggagcagatttggtgttttccaccccttcacaggattctgaggtaactcatttctgttggccttggccttgtatggggaggatttccctccagccttgtatggggaggatttcccttgtatggggaggattttccctccagcttgtgggaaaggaatcaaggaccagagacaggcaggggagaagatcactgagggatttacggcagcagcctctgcacggcttccccacgacctccccagctgcttgctggacgctgctggagaaacagcacatcccaagatcatcatggccccagcatcctcttgaacttagtaacagttggcctgacagatgaagcggatatcatccctgccttagaagttctctagcccctttcttagagataagctgctatttcattcctaaaagaagtcatggctgttcaggtgagaagaacggtttagtcagcatctatgcaacactgtagagatgcttagtgagaggtgttgcaggagagtggcagaccgcagggcccgaggtaaggtttcttgtccatctctggaattttggctttttgcaccctgtaaagtcacgtcccctttttttctggtgctttggtggtgacgtagggagaggtgaggatgagaagaggagccatgtcctatggattcccagatccagactcctcttccctgggaaagctggattggagctggcccctccttctgtgccttcgggctgtggaggaggaggcccctgcagggagctgcctggggcgagcgctgggggcttttcctgcagtgcattagcagcatgtcataatggaaagtggctggatttctttccagttgtaatcaatggttaagatttaacctagcaacattgtaggggtacacagccaaatgattcaggaaaaaagatgcaggttgagtctggaggaatccctgtgccagcttcctcatgctccctccctctctcagaaatcacatggaacccattctcccctcagcagtgaaaatgcattcagcctgtgtgcagtgtttctgcccagggaagcccagtagggcctccatgcccggggtgtttactgggatctggttatgtagacaccacctgcctagcacgcaccaaaattccagactttcaggaaaacaggtgcctgtgccacattatttgcacggagagactgtgtccagtgaacggttctgatcagtaaactgttgactaggaacatcccgagagccaagttcccagatgccagccaagggccatctgacctgttttgaatctcaatttcctgatacagaaaacaaaggattgtcagctgacctctgtcctgtgtgcccagtggccccaggtgacgtgtcttcaagaagaggctgagctgcggtgcttgtaaggggtctcattctgtcacccaggctggagtgcagtggtgcaatgatggctcactgcagcctcgacctgggctcaagtgatcctccacctcagcttcctgagtagctgggaccacagatgggtccgctgtgtgcagaggctccatgggatgtgttgtcttcatagtagcaggtcgctggaccatgggtccgcaaggtgggatttttggactgttgtctggaatatgtttctttgcatcctgcagagtcatgtgctgttcctggggcttggatgatgtaggggaagcaaggtgaaagtggtatcccgtggttccacgttctgtcctgctgtggggctgtccctcacatgctttcagtggctgttgcagaggaagagcctccggaaatctgcgtgggtaaagtgagctccccgggggaaccgtcctcctcccttgagcgctggtgtgtccatagtgtgctgtgatctggattagcagtgagtttttctttcagggtgtgtgtgtatgatgttaggaccatatgctcctgaccttttccaacccaaaagcgtttccatttttttaatgctggaagtgtcttaactccttttggggtcttagaaggacacacggtggccgtggctgggcctctgctcagctgggctgctctccctgcctcaggcccttgacaccagcctccctcccttgctggctctctttctgtccttccctgctcttgtatccaaaagtgatcatgggttgcctgtgtcccgatcattaacagtgcaggggtaggagtgctgaaagacatcttccctgcgttggtccagccttccctttcaaaccctggagctttcccacgctgcagcctttttccaactaggctttcagagcttgggcctttgtgggcccatgtgatgtggtgactagacccaccccctgacttctgagggttcattttgtcttttcatgttagggatcctcctgccagaaaccagtctgcatttctctctgggccccacgctggaatgaattcagatagcagtgaagggcacacgtgagaactgcgaatcacgggctttgcttcatgaaatgtgaaatccacattgtttccacaggcaccatcagtaatgtcgaacaaatggagaaagttgcaggtggggctaggaaagctgtattcctgtggattactctagctggtcatttgccccgattgtgaactgcttgaaagaaaaacgaaacttctaagatgtttgtcctttcatgtcctttctgttgggattttttatttggtgtgcgtgaatgaggagcttcgccctgcttgaatgggacccctctcagtggtgtcagcttggggaggaggagatggccctggagactaaatacttgtatgctttcttaccctcttaggtctcagccttagatccaaggacagtccaaggaagtcctaagaccatggagttggtgatctgggatctgggtttgctgatatttctcaccgtggtgagttgatgccaagagccagaacccacagccagaggctcagctggtccgtgtttatgcagatgggaacctcaaatcactggtctcacttgtcctttgtttcagaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 291357 - DNA, 1219 bp, Homo sapiens
acgagcgtagcttccttgtcgtgtggcctcagtccttcgccgtccctcgccgtccttcgccatcgcacgccaccgcaccccatctctcgaaatctgcagacatcttgatttttcccacgctgtctgtcaggtctccgccgccactcgacgccagggcgccgggtgagtccacagcagggcgcatggtcggctccactctcaccatcgggggaaactgaggccccggggaaggcggccagagaggtcaggccctgtccttggtgcagtgtctcgtcctctttgccggagtgagccccccaggattcgcgtgtcctcgggaaagacactggcaggccttgtgggctgtgctgcacctcggacggcttcgcaccagccagcgccctctctctcctgcagcactctgatctgcaccccctgaggggcttccactgtccgcggggtgagaatgcccctgggagtgtcacatgactgccgccccatgtgtgtgagaggcgtcctctgggagagcatggatcctgaggtcccaggattgtcagctgacctctgtcctgtgtgcccagtggccccaggtgacgtgtcttcaagaagaggctgagctgcggtgcttgtaagagtcatgtgctgttcctggggcttggatgatgtaggggaagcaaggtgaaagtggtatcccgtggttccacgttctgtcctgctgtggggctgtccctcacatgctttcagtggctgttgcagaggaagagcctccggaaatctgcgtgggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttctctctccactcccgggagtggagagagaacggtgcaatggctgatgacaggcctgcctgcttagaaggcttaaaatctcgaatctgtttctgtg

SEQ ID NO: 291358 - DNA, 2849 bp, Homo sapiens
gcccctgcattcgaaagtgatcatgagctgcccgtgccctggtcattggtagtgcagggagaggaactgccgagagcacttccccgtgtttggagggtccactcctgtctcttccaaaccctggagctttcccacacctcctccctcccaccacgtcttagatggctcctggtgcctggcatcatctagtgggttgtgttgctcttctccctggcccagggcagttattgtgagacatgagggaagggtgtggggtgatgggtttggcctcatggagcagaagggctgggtgtggagctgagatagggctgccctgctccttcctcccggaagctttctctgcctccacacctctccttccacgtccttatccagcccctgcaccaagctgaacctgtggaaattgttgcctgacttgtttcctggctctctttgctgtggtctcaagggcagtgtctgaattttgttccctactttgttatgtctgccagatggtcagtattctgacagtgtgggacaaaggaaaaacggcagcctgggcaaccccgcctctataagaactaaaaaattagccaggcatggcggtgcatgcccctgtagtcctagcttctcaggaggctgaggcaggaggctctcttgagcccgggaggacaaggctgcagtgagccatgaccatgccactgcactcagcctgggcaacagagtgagaccctgtctcaagaaagaaaaacgagaaagggagagtccctccactgtaaggagatcgggttcattacattttggggtgttggagaaaaatactgagtcagcacctgtgtgggattggtgggagcagatttggtgttttccaccccttcacaggattctgaggtaactcatttctgttggccttggccttgtatggggaggatttccctccagccttgtatggggaggatttcccttgtatggggaggattttccctccagcttgtgggaaaggaatcaaggaccagagacaggcaggggagaagatcactgagggatttacggcagcagcctctgcacggcttccccacgacctccccagctgcttgctggacgctgctggagaaacagcacatcccaagatcatcatggccccagcatcctcttgaacttagtaacagttggcctgacagatgaagcggatatcatccctgccttagaagttctctagcccctttcttagagataagctgctatttcattcctaaaagaagtcatggctgttcaggtgagaagaacggtttagtcagcatctatgcaacactgtagagatgcttagtgagaggtgttgcaggagagtggcagaccgcagggcccgaggtaaggtttcttgtccatctctggaattttggctttttgcaccctgtaaagtcacgtcccctttttttctggtgctttggtggtgacgtagggagaggtgaggatgagaagaggagccatgtcctatggattcccagatccagactcctcttccctgggaaagctggattggagctggcccctccttctgtgccttcgggctgtggaggaggaggcccctgcagggagctgcctggggcgagcgctgggggcttttcctgcagtgcattagcagcatgtcataatggaaagtggctggatttctttccagttgtaatcaatggttaagatttaacctagcaacattgtaggggtacacagccaaatgattcaggaaaaaagatgcaggttgagtctggaggaatccctgtgccagcttcctcatgctccctccctctctcagaaatcacatggaacccattctcccctcagcagtgaaaatgcattcagcctgtgtgcagtgtttctgcccagggaagcccagtagggcctccatgcccggggtgtttactgggatctggttatgtagacaccacctgcctagcacgcaccaaaattccagactttcaggaaaacaggtgcctgtgccacattatttgcacggagagactgtgtccagtgaacggttctgatcagtaaactgttgactaggaacatcccgagagccaagttcccagatgccagccaagggccatctgacctgttttgaatctcaatttcctgatacagaaaacaaaggattgtcagctgacctctgtcctgtgtgcccagtggccccaggtgacgtgtcttcaagaagaggctgagctgcggtgcttgtaaggggtctcattctgtcacccaggctggagtgcagtggtgcaatgatggctcactgcagcctcgacctgggctcaagtgatcctccacctcagcttcctgagtagctgggaccacagatgggtccgctgtgtgcagaggctccatgggatgtgttgtcttcatagtagcaggtcgctggaccatgggtccgcaaggtgggatttttggactgttgtctggaatatgtttctttgcatcctgcagagtcatgtgctgttcctggggcttggatgatgtaggggaagcaaggtgaaagtggtatcccgtggttccacgttctgtcctgctgtggggctgtccctcacatgctttcagtggctgttgcagaggaagagcctccggaaatctgcgtgggtaaagtgagctccccgggggaaccgtcctcctcccttgagcgctggtgtgtccatagtgtgctgtgaacctccagtgaccccagagactttgctgtaattatctgccctactgaccctaaagaccttcctagaagtcaagagctagccttgagactgtgctatacacacacagctgagagccaagcccagttctctgggttgtgctttactccacgcatcaataaataattttgaaggcctcaaaaa

SEQ ID NO: 291359 - DNA, 320 bp, Homo sapiens
acaccacctgcctagcacgcaccaaaattccagactttcaggaaaacaggtgcctgtgccacattatttgcacggagagactgtgtccagtgaacggttctgatcagtaaactgttgactaggaacatcccgagagccaagttcccagatgccagccaagggccatctgacctgttttgaatctcaatttcctgatacagaaaacaaaggtagggcataattgatttttacagacgtgaccccatgatcctgctctctagtccccagatttttccagggcttttgtcagaggtgtttcccctttgattccccttggtggt

SEQ ID NO: 291360 - DNA, 493 bp, Homo sapiens
cgctggtggtttgtttatggaagagatactattactatctgaccaatggaattcgcaaagacatgattgcccctgaggagggtgaagtgatggttcggatttcaaagctgatttctaacacgctgctgacgagtcccttcctggagcccctgatggtggtcctcgtgcaggagaaggagaatgactattactgtagcctcatgaaaagcatcgttgattacatcctcatggacccaatggagagaaaacggctctttattgagagcatcccccgcttgtttcctcaaagagtgatccgggcccctgtgccctggcacagtgtctacaggagcgccaagaagtggaacgaggagcatctgcacacggtgaaccccatgatgctcaggctgaaagaactgtggtttgcagaattcagagacctcaggtttgttcgaacagcagaaatactagcgggaaaattgcctctgcagcctcaggaattttgggatgtgat

SEQ ID NO: 291361 - DNA, 4353 bp, Homo sapiens
  misc_feature (1188)..(1188): n is a, c, g, or t
cgctggtggtttgtttatggaagagatactattactatctgaccaatggaattcgcaaagacatgattgcccctgaggagggtgaagtgatggttcggatttcaaagctgatttctaacacgctgctgacgagtcccttcctggagcccctgatggtggtcctcgtgcaggagaaggagaatgactattactgtagcctcatgaaaagcatcgttgattacatcctcatggacccaatggagagaaaacggctctttattgagagcatcccccgcttgtttcctcaaagagtgatccgggcccctgtgccctggcacagtgtctacaggagcgccaagaagtggaacgaggagcatctgcacacggtgaaccccatgatgctcaggctgaaagaactgtggtttgcagagtaagaagtccctccctttttttttcattccctttcttgaccacatccacgtgtaagcaagcctattctgctgtgcacagtgggggtagccctgacagcatagagaaatgaaagaaaaaaaaatctaggccaaatatgcatgtgaattataagtgacacctttccttgcaggcttacgtggccctcctttgtgtccccagggcaccctgtgcctgtctctaagcactggaatatcctgcttaattgcacagacttggagccagcctgctcaggtctaactcctagctctgctgctttacaggcatatatgtggtcgcatcacttttctgtgccttgcttcctttacctctaaatttgcgataatgttaataagagtttccacttcataggattgataagaggaataaataacttactacatccaaagcacttagaacagtatctaatataacttaagcaccagtaattgttaatttggcattacctccattacaacatcaccctcagtttttgtttttgagacagagtttggctcttgttacccaggctggagtgcaatggcgcgatcttggctcactgcagcctccgcctcccgggttcaagcgattctcctgtctcaacctcccgagtagctgggattacaggcatgcgccaccatgcctggctaattttgcatctttagtcaagatggggtttctccatgttggtcaggctggtctcgaactctcgatctcaggtgatctgccagcctcagcctcccaaagtgctgggattagagncatgggccatcgcacccagctcacccttggttataatagaacatttacttatttgtctccctttagcctatgaagtgtgtgcgggcttgggttttattccttttttttttttttttttgagacgaatctcaccctgtcacccaggctggagtgcagtggcataatctcgattcactgcaacctcctcctcccaagctgaagcaatcctcccacctcagtctcccaagttagctgagtagttgggaccacagacccacaccaccacacccagctaattttttgtattttttgatagagacggagtttcaccatgttgtccagactggtctcaaactcctaagctcaagcaatccacccacatcggcaccccaaagttctgggattacaggtgtaagccaccacgcccggacggtcttattcctttatgtaactcagtgccagtacagggctggcaagcagtgatctctcaggtatatttatcaataattaaatttgcgaaactccgtctcaaaaaaaaaaaaattgtaggagtccagatgagacagaagccaccttttttcattctttcattttaaaaaaaagtgagatatccacattccataaaattcaccctttgaaagtacacaatgcaagtttttaatatattcacaagtttgtttaatccttaccactgtctaattcaagagtattatcattaccccaaaaagaaacccgggaggcagaggtttcagtgagctgagatggcgtcaccgcactcctgcctgggcgacagagcgagactccatctccaaaaaaaaaaaaagaaaaaagaaaaaaaaaaaaagacctactttgtgagagagtatagtgtcctccatgatgtcaacctcaatgaatcagataggtcccaagccatatctgtgggttaataatccatcatgaatcaattgccattaacttgccaagaactttttttcaatttcagtttgaagtttcactcttctgtgtgcttatttgtttgttggtttgttatgttttagccactgtaggcttctagagagaataaccattcctttcctggcccacgccctttccagtttgctttccagggtagagttactaattaaattccagacacttattaacaaacttttattactagacaggatcatgcacatggatgtaactccttttagctccatcttttcctcactccctctgattggttggtatgaccaaagggccattgtccagttccatatagggaagggatctgtggggtcttgctggctagctccctcacccttccaccttctcactctctccatgcattatgtatgcttcacatgggccttgctcatgtgaaacgaatgcccaggagttcaaggttgcagtgcaaggaggcccaagcattcttctctttgcaatctggtacttacagggttctaagtactccattaaaactgggtgtgtgggaggagaagaaacactgggcagctctcctacaaccagtatccctaggaaggaaatggaagaaaagaccctgtaatttggatgactatgtatggggacagctgaaatacataccacttaagttctccttcactgctgctgctgctgatcggcaatgtgtgaaagcagctgagccaggagagcccagcatgcacgcggctgccactgcaatggcaggtaccagggccggtactacatttgatgaattacaatgccaagaagacatggtttgtaccaggtttgaaaacaaggcctatgtgaataccaatgactttacgagacaataaggaaaaacaacgtagactgagttccccatctagtgacacccacagccctagcttcctccttaagcccctcagactgttttatctctgaactggttagtgaagacttaaaaacatagtcctgcaggttgactaagaaaaatctttaagaatggcaactggtgggtgttaccttcactcactgcaagatctgccgtatatatggtttaaaaagaattttaaaagttagttaaggtcaatcatggtggctcacacctataattttagagctttgggaggtcgagaagcacgaggattgcttgaggccaggagttcaatatcagtttgggcaatatggcgagacctcatctctacaaaattaaattagctggggtggtggcacacgtctgtagtcctagctactcaggaggctgaggcaggaggatcgcttgagcccagaagttcaagggtgcagtgagctatgattgcaccattgcacctccagcctgggcaacagagtgagactctgtcaaaaaaaaaaaaaaaaaaagttggtagggaaaagctaacaagagacttttgaaaatagaaaatagagtaaatagcattattcaagacacagaaagaaagcaggaaagcatatttgtgagaaataattattaaaggggctaggcacagtggctcacacctgtaatcccagcactttggtaggccaagatggctggatcacctgaggtcaggcgttcaataccagcctggccaacatggtgaaaccccgtctctactaaaaatacaaaaaattagccgagatggctggatcatctgaggtcaggagttcaataccagcctggccaacgtggtgaaaccccgtgtactaaaatataaaatacaaaaaattagctgggattacaggcacacaccacaatgccaggctatttttttgtattttcagtagagacagggcttttgccatgtcgcccaggctggtctcgaactcctgagctcaggcaatccactccccctttggcctcccaaagtgctgggattacaggcgccaccgcgcctggccaaaaggcatttcattctttttattttattttattattatactttaagttttagggtacatgtgcacaacgtgcaggtttgttacatacgtatacatgtgccatgttggtgtgctgcacccattaactcatcatttacattaggtgtatctcctaatgctatccttcccccccccaccctccccaccccacgacaggcccaggtgtgtgatgttccctttcctgtgtccaagtgttctcattgttcaattccgacctatgagtgagaacgaaggcatttcattcttgatgatggtggtggtgatgatgttgatgacaattatattaataaagccattgctgtg

SEQ ID NO: 291362 - DNA, 2621 bp, Homo sapiens
ggtcgctgggatattcagttaagggagcttcactttggagatatatcctgaatataaccccttgaccccagacaaatgatttagaccataaagaaatattcacgcagcccagaattgtgcttctaacaagagcacgaagagctgctttgtaggagaatcacttgaacccgggaggcagaggtttcagtgagctgagatggcgtcaccgcactcctgcctgggcgacagagcgagactccatctccaaaaaaaaaaaaagaaaaaagaaaaaaaaaaaaagacctactttgtgagagagtatagtgtcctccatgatgtcaacctcaatgaatcagataggtcccaagccatatctgtgggttaataatccatcatgaatcaattgccattaacttgccaagaactttttttcaatttcagtttgaagtttcactcttctgtgtgcttatttgtttgttggtttgttatgttttagccactgtaggcttctagagagaataaccattcctttcctggcccacgccctttccagtttgctttccagggtagagttactaattaaattccagacacttattaacaaacttttattactagacaggatcatgcacatggatgtaactccttttagctccatcttttcctcactccctctgattggttggtatgaccaaagggccattgtccagttccatatagggaagggatctgtggggtcttgctggctagctccctcacccttccaccttctcactctctccatgcattatgtatgcttcacatgggccttgctcatgtgaaacgaatgcccaggagttcaaggttgcagtgcaaggaggcccaagcattcttctctttgcaatctggtacttacagggttctaagtactccattaaaactgggtgtgtgggaggagaagaaacactgggcagctctcctacaaccagtatccctaggaaggaaatggaagaaaagaccctgtaatttggatgactatgtatggggacagctgaaatacataccacttaagttctccttcactgctgctgctgctgatcggcaatgtgtgaaagcagctgagccaggagagcccagcatgcacgcggctgccactgcaatggcaggtaccagggccggtactacatttgatgaattacaatgccaagaagacatggtttgtaccaggtttgaaaacaaggcctatgtgaataccaatgactttacgagacaataaggaaaaacaacgtagactgagttccccatctagtgacacccacagccctagcttcctccttaagcccctcagactgttttatctctgaactggttagtgaagacttaaaaacatagtcctgcaggttgactaagaaaaatctttaagaatggcaactggtgggtgttaccttcactcactgcaagatctgccgtatatatggtttaaaaagaattttaaaagttagttaaggtcaatcatggtggctcacacctataattttagagctttgggaggtcgagaagcacgaggattgcttgaggccaggagttcaatatcagtttgggcaatatggcgagacctcatctctacaaaattaaattagctggggtggtggcacacgtctgtagtcctagctactcaggaggctgaggcaggaggatcgcttgagcccagaagttcaagggtgcagtgagctatgattgcaccattgcacctccagcctgggcaacagagtgagactctgtcaaaaaaaaaaaaaaaaaaagttggtagggaaaagctaacaagagacttttgaaaatagaaaatagagtaaatagcattattcaagacacagaaagaaagcaggaaagcatatttgtgagaaataattattaaaggggctaggcacagtggctcacacctgtaatcccagcactttggtaggccaagatggctggatcacctgaggtcaggcgttcaataccagcctggccaacatggtgaaaccccgtctctactaaaaatacaaaaaattagccgagatggctggatcatctgaggtcaggagttcaataccagcctggccaacgtggtgaaaccccgtgtactaaaatataaaatacaaaaaattagctgggattacaggcacacaccacaatgccaggctatttttttgtattttcagtagagacagggcttttgccatgtcgcccaggctggtctcgaactcctgagctcaggcaatccactccccctttggcctcccaaagtgctgggattacaggcgccaccgcgcctggccaaaaggcatttcattctttttattttattttattattatactttaagttttagggtacatgtgcacaacgtgcaggtttgttacatacgtatacatgtgccatgttggtgtgctgcacccattaactcatcatttacattaggtgtatctcctaatgctatccttcccccccccaccctccccaccccacgacaggcccaggtgtgtgatgttccctttcctgtgtccaagtgttctcattgttcaattccgacctatgagtgagaacgaaggcatttcattcttgatgatggtggtggtgatgatgttgatgacaattatattaataaagccattgctgtg

SEQ ID NO: 291363 - DNA, 5568 bp, Homo sapiens
gctgaaatactgacattgaatattatatgaaatagtgaactgccatctttcatggttgtcaaatgctagggttaaagctgactcaaaatgttcacagatatattctgaagtatttacaattaaatgacatattgttttggagttgatagtggctgaatctgagtgatgggtacgtggaggttccttatattatgctctctacttttgtctgggcttggatttttccttataaaaagtaaaaaacaagtacttagacataggcctaactaataatgataggatgtggaatgtgatgaataacttattttgtaacagaaatagtattcattttacctgcctttatttactcttttacaattgccaagttgcattaatatgttctgtttaaaaaaatagtgtgatatcattttaaaaagtcactgcatctatggtactgacattctttccctcttacagattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaaaagctcacactagatatcaatgaacggcaagaacaagaagattatcaagaaatgttgcagtctcttgcacagcgcccagctccagcaaacaccaatcgtgagaggcggcctcgctaccaacatccgaagggagcacctaatgcagatctaatctttaagactggtgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattta

SEQ ID NO: 291364 - DNA, 5369 bp, Homo sapiens
gctggtagtggctaccttacgtattgccagtctgaaaaattcgctcttctcatcgactggggaatttgaaagagctgttaagtgaatggcactcatatgagcctttgccccggacccgccaccccagagtcaagctgagggcatcggcatgccgcagggaagacgatcaggactgtttttaatcgggcagtcgcgcggatggccttttccctctcgcctccttccgccccgcccccactctcagcccggccgcgctgattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaaaagctcacactagatatcaatgaacggcaagaacaagaagattatcaagaaatgttgcagtctcttgcacagcgcccagctccagcaaacaccaatcgtgagaggcggcctcgctaccaacatccgaagggagcacctaatgcagatctaatctttaagactggtgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattta

SEQ ID NO: 291365 - DNA, 5045 bp, Homo sapiens
gcggccgcctactactactaaattcgcggccgcgtcgaccagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaaaagctcacactagatatcaatgaacggcaagaacaagaagattatcaagaaatgttgcagtctcttgcacagcgcccagctccagcaaacaccaatcgtgagaggcggcctcgctaccaacatccgaagggagcacctaatgcagatctaatctttaagactggtgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattta

SEQ ID NO: 291366 - DNA, 1516 bp, Homo sapiens
ctgtgtagtgctctagaggtcccaggattcgtagatccaagaagagaggatgagaatgaaaaagctcacactagatatcaatgaacggcaagaacaagaagattatcaagaaatgttgcagtctcttgcacagcgcccagctccagcaaacaccaatcgtgagaggcggcctcgctaccaacatccgaagggagcacctaatgcagatctaatctttaagactggtgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattta

SEQ ID NO: 291367 - DNA, 1418 bp, Homo sapiens
cccccactaaatagaaacgggttgtgatggtaatggtgtgggggaaatgaacttgagctttaaacttgatttgagtttcagtgtctctgaattgaacatcccacgttggaagaagatacatttgggctgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattta

SEQ ID NO: 291368 - DNA, 3943 bp, Homo sapiens
  misc_feature (3943)..(3943): n is a, c, g, or t
ggtggggggaggggaggggagagcccgagcgctggagttggtgctgggaaacccggggctaatgttgacaacaggctcgagattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaaaatgttgcagtctcttgcacagcgcccagctccagcaaacaccaatcgtgagaggcggcctcgctaccaacatccgaagggagcacctaatgcagatctaatctttaagactggtgggagaggaccttgatccagcagtccgtgccaattcattaggtccttgatcctgatcgttgcgctaagcgtcatcctttcagaaatgccn

SEQ ID NO: 291369 - DNA, 2726 bp, Homo sapiens
ggtggggggaggggaggggagagcccgagcgctggagttggtgctgggaaacccggggctaatgttgacaacaggctcgagattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggagtatcaaccctaaatttaatcagagcacagatgcagtcgggtccgagctcgatc

SEQ ID NO: 291370 - DNA, 193 bp, Homo sapiens
caaacgtcagcaagaagaagaagcagctgctcagatgaagtaaggcagttgattgtatttattgatgtgagggaatgggaagattggaatattttgggaaaaaaacattatttgaaatatagcgtcctgggtgcagctctttaagaattgggagtatcttaatttacttgttctgttagtttcactgactaga

SEQ ID NO: 291371 - DNA, 306 bp, Homo sapiens
tactttacgtctttgaccaaacacctgaaaagggaccacagggagctccagaatactgagagacaaaacaggtgattttcaaatgtttctcagagttgagaatttattttggagctcatacttaaaaatgtttaaagtcttcatgccactgaaagaacttatggaaaagggctccttacaggtgatttcttaacattccaggaaaatttcaaagtagaacagtctgagtactcatgttttaatgtgagtctacgatagattttgtttctgattttaaaaaaatctgccaagtagatggtgattttt

SEQ ID NO: 291372 - DNA, 5193 bp, Homo sapiens
ggtggggggaggggaggggagagcccgagcgctggagttggtgctgggaaacccggggctaatgttgacaacaggctcgagattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaaaagctcacactagatatcaatgaacggcaagaacaagaagattatcaagaaatgttgcagtctcttgcacagcgcccagctccagcaaacaccaatcgtgagaggcggcctcgctaccaacatccgaagggagcacctaatgcagatctaatctttaagactggtgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattta

SEQ ID NO: 291373 - DNA, 535 bp, Homo sapiens
gctggtagtggctaccttacgtattgccagtctgaaaaattcgctcttctcatcgactggggaatttgaaagagctgttaagtgaatggcactcatatgagcctttgccccggacccgccaccccagagtcaagctgagggcatcggcatgccgcagggaagacgatcaggactgtttttaatcgggcagtcgcgcggatggccttttccctctcgcctccttccgccccgcccccactctcagcccggccgcgctgattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaagggtgatgcggccgaaactcccacctcccacaaaaatggactgggctgccagacgcaact

SEQ ID NO: 291374 - DNA, 5514 bp, Homo sapiens
gctgaaatactgacattgaatattatatgaaatagtgaactgccatctttcatggttgtcaaatgctagggttaaagctgactcaaaatgttcacagatatattctgaagtatttacaattaaatgacatattgttttggagttgatagtggctgaatctgagtgatgggtacgtggaggttccttatattatgctctctacttttgtctgggcttggatttttccttataaaaagtaaaaaacaagtacttagacataggcctaactaataatgataggatgtggaatgtgatgaataacttattttgtaacagaaatagtattcattttacctgcctttatttactcttttacaattgccaagttgcattaatatgttctgtttaaaaaaatagtgtgatatcattttaaaaagtcactgcatctatggtactgacattctttccctcttacagattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaaaagctcacactagatatcaatgaacggcaagaacaagaagattatcaagaaatgttgcagtctcttgcacagcgcccagctccagcaaacaccaatcgtgagaggcggcctcgctaccaacatccgaagggagcacctaatgcagatctaatctttaagactggtgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagggtttacagcctctgtctctaaacaaagtatggaaacaagtagagcttttattttgcttttgtttttgttttgttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattta

SEQ ID NO: 291375 - DNA, 3989 bp, Homo sapiens
ggtggggggaggggaggggagagcccgagcgctggagttggtgctgggaaacccggggctaatgttgacaacaggctcgagattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaacagaactagaattagtggaacaagaagatgtgactgaattgctgcaatctcatgaccaagctttcacagatgaggagttgctaattacagataaacacacaaaggtggttcttgatatggaatctactcctggtgaagatgctgtgaacacagtttaaatgacaacaaaggatttagaatattacataaactttattgataaaggagcaaccaggcttgagaggactggcttaaattttgaaagaagtttt

SEQ ID NO: 291376 - DNA, 1063 bp, Homo sapiens
agcggattcttgggcccgctgagcgtgggggcaggccgctggaatttgacccgagtgggccgcgatcggccgaggatttggggtaccctttgacccaggcggggcgcgatccgcctaggatttggggtcccctggcgccgaaccctgagttgccagatgtagcaagtaaaagtacagttcttctaaatttgaatttcagacaagacaggttttagggttcgtctcatgtaatgttgagaaggtgagggcggcgcctgggcggattcttctccgttccagaatccctttctcttttcaaaccgcattacagcccgagttaaattctttaacctactcctctctgcttaccctcataaggtttacggccgtatcaggctacggccgcagcctacggctgtttgattccccttttggccacaagaaagttttattcgaactacttgctttcctttatcaagaaaatggcaacgcacacacatacatgcacacacaaataaaaacacaaagctacgtttttcaggttttgttctagatcgtgtttgtggctgtgttcttcaggatattttccctcaccttgaggatttccctcatctacctttctttgggagatacgactgaaaccaacaaaagccaagtttggtaaataagaagtttaaacaagtgcttctctgtacagctcatccacttcctcatctgtaaaccgatcccccatggttgtcagcagctctctcaagtaatcttcctgtatggtgcctggagaataaagaacaagggatcagaatacatactattctgagggttaattacaaagaatatctatacttgactaagcatgttctgtatgttacaaactataaacatgcaaatatatgaactacagggtgtccacctacttaaaacagcctcagcagagaagtgcctagaaaaatgcctagctgcttagcagcactgctccgctctatcatttgctctatcattctgcctccacattcagcttctgatctcttgataagagagactaaacctatgcctaaacaaagtaataaaaagtatggttaaagaa

SEQ ID NO: 291377 - DNA, 725 bp, Homo sapiens
agcggattcttgggcccgctgagcgtgggggcaggccgctggaatttgacccgagtgggccgcgatcggccgaggatttggggtaccctttgacccaggcggggcgcgatccgcctaggatttggggtcccctggcgccgaaccctgagttgccagatgtagcaagtaaaagtacagttcttctaaatttgaatttcagacaagacaggttttagggttcgtctcatgtaatgttgagaaggatttccctcatctacctttctttgggagatacgactgaaaccaacaaaagccaagtttggtaaataagaagtttaaacaagtgcttctctgtacagctcatccacttcctcatctgtaaaccgatcccccatggttgtcagcagctctctcaagtaatcttcctgtatggtgcctggagaataaagaacaagggatcagaatacatactattctgagggttaattacaaagaatatctatacttgactaagcatgttctgtatgttacaaactataaacatgcaaatatatgaactacagggtgtccacctacttaaaacagcctcagcagagaagtgcctagaaaaatgcctagctgcttagcagcactgctccgctctatcatttgctctatcattctgcctccacattcagcttctgatctcttgataagagagactaaacctatgcctaaacaaagtaataaaaagtatggttaaagaa

SEQ ID NO: 291378 - DNA, 538 bp, Homo sapiens
gtattttatcataaagtttaattatgattcagaaaaaatcgagcgaataactttctctgaaaaaatatattgactctgtatagaccacagttattgggggagaagggctggtaggttaaattatcctattttttattctgaaaatgatattaatagaaagtcccgtttccagtctgattataaagatacatatgcccaaaatggctgagaataaatacaacaggaaatgcaaaagctgtaaagctaagggcatgcaagagaaaatctcagaatacccaaagtggcaacaaggaacgtttggctggaatttgaagttatttcagtcatctttgtctttggctccatgtttcaggatgcgtgtgaactcgatgtaattgaaattcccctttttatcaataggtgcttctctgtacagctcatccacttcctcatctgtaaaccgatcccccatggttgtcaggaaagtggctaagggggcattgtctcagtggctctcgtttgggggctcatggggagggtagcaccaggcatagccact

SEQ ID NO: 291379 - DNA, 807 bp, Homo sapiens
cgcggccgctcgcgcgcagccccgcacctccgcccctgcctctgcctcctgggccatgccctgctgtttacatgccggtgaggtccccggccgctccgaacccctccgagccccggctccccgagggtgaagcccgccggcccgcgaactggactggtggatctctcagacctggggccccggactccgatctccgccgtctccgccaccatcagggcgggatccggctctggtgttttgaggagggggtgtggtgtagggaaaggaatcccgtccctctccaccttttttcgccttcggggcttcagactcagggaactcgctcatggctttcttgatgaagaagaagaaattcaaattccaaactactttcaccctggaggagctgactgcggttcccttcgtgaacggggtcctcttctgcaaggtccggctgctggatggaggggattttgtcagcttgtcgtcaaggagctgaaaggcgggaaggcttattccaaggtaagaggggctgtgtgaaggggcagtgggatggaatggggggtggcatgggacaggcacaagggaagcctccagccccttttctgccacaagcaagaggcactcagccctacctgagatgtgttattttttagaaatatctttattgatggtctttgcactcaatataaaggcagcatatggttgttgcaatataaatggtacagaagtccacagagcaaaagggccagtttctgtcccctttcctctctccaggcctctttctgggaccccattattggatagattaagacctttccagacctt

SEQ ID NO: 291380 - DNA, 494 bp, Homo sapiens
tcgggtgggggtgagggggcggtgagcaagaaggaaactgaggggctggcttccttatgggtttgtaaacacacccctccctggccccctctgaaaatgaggaagcatcttggggaaagaaaccaatctggttgggagcgagatcacagcagagctacatgctgagccccgagagtccccgactccagggctgggcctgggctcggcagggaaaggagctgaccaggtttcctgacttcccactgccctcttggtcaccctcacatccctctgagcctcagtttcttcacctgtcaagtggggcaggatgcagtgactccctgccgaggtgatcttctgcacgatgaggtgatcttctgcacgataaggtgatcttctgcacgatgaggtgatcttctgcacgataaggtgatcttctgcacgatgaggtgatctactgcacgataaggtgatctgaggtgatcttctgcacgataaggtgatcttctgcacga

SEQ ID NO: 291381 - DNA, 4559 bp, Homo sapiens
cgcggccgctcgcgcgcagccccgcacctccgcccctgcctctgcctcctgggccatgccctgctgtttacatgccggtgaggtccccggccgctccgaacccctccgagccccggctccccgagggtgaagcccgccggcccgcgaactggactggtggatctctcagacctggggccccggactccgatctccgccgtctccgccaccatcagggcgggatccggctctggtgttttgaggagggggtgtggtgtagggaaaggaatcccgtccctctccaccttttttcgccttcggggcttcagactcagggaactcgctcatggctttcttgatgaagaagaagaaattcaaattccaaactactttcaccctggaggagctgactgcggttcccttcgtgaacggggtcctcttctgcaaggtccggctgctggatggaggggattttgtcagcttgtcgtcaagggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggtgaggcctactgcttggtgccccctggagaacagacctctcccggtggtgccttgaacctccgcttctttacctataacacagggaccgtaaggtccccacctcagagggttgggtggtgacgattccactagctgatggccctgaagggtgcagccatgcccggcgtgcagcaggttctgttcatggctgctcttgcggttttgtggatcagacaagagcacgatctgctaggtggccttaggaagctgacttacctgctcattgcctggcatcctcgtctataaaatcggctcatgatggcagctgcaccctattgtgcatgtgaggtttcagtgaagtacagcacggagcgcacagggacattctgagcgccgctgcggctgactggcattattgtcgtcgttctgtgcttgtacctgttactgccctgaccgttgtgacttgtccccccacgacctgacccaggcggaagaaggactcggtggagagccacccgacctgggtggacgacacgcggatcgatgcggatgccatcgtggagaagatcgtgcagagccaggacttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcagctcctaaatgtagagatgcctgtggctgagggggcctctctacctgtgtccccactcactccaggagcactggctttggtcacgtcttagcagcagggccttgctccgttgttcccttgccctggtggtgggggggccagaccgcctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgtgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggcggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggtttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttc

SEQ ID NO: 291382 - DNA, 3846 bp, Homo sapiens
aacgaagaaagagtctctgataacccttccaccccacctttggtcagacctgctctgagctccctgcctgccttctggccattatcccttcataccagtgtgaataagctgcttggccagggagcctgaagtccaggattctgggttaaaacaatctccttctccggaccttgcttctatcattttaaaatttcagttctgtagcccagacctgggccacattaggggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggacttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcagctcctaaatgtagagatgcctgtggctgagggggcctctctacctgtgtccccactcactccaggagcactggctttggtcacgtcttagcagcagggccttgctccgttgttcccttgccctggtggtgggggggccagaccgcctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgtgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggcggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggtttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttc

SEQ ID NO: 291383 - DNA, 3797 bp, Homo sapiens
cgcggccgctcgcgcgcagccccgcacctccgcccctgcctctgcctcctgggccatgccctgctgtttacatgccggtgaggtccccggccgctccgaacccctccgagccccggctccccgagggtgaagcccgccggcccgcgaactggactggtggatctctcagacctggggccccggactccgatctccgccgtctccgccaccatcagggcgggatccggctctggtgttttgaggagggggtgtggtgtagggaaaggaatcccgtccctctccaccttttttcgccttcggggcttcagactcagggaactcgctcatggctttcttgatgaagaagaagaaattcaaattccaaactactttcaccctggaggagctgactgcggttcccttcgtgaacggggtcctcttctgcaaggtccggctgctggatggaggggattttgtcagcttgtcgtcaagggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggacttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcagctcctaaatgtagagatgcctgtggctgagggggcctctctacctgtgtccccactcactccaggagcactggctttggtcacgtcttagcagcagggccttgctccgttgttcccttgccctggtggtgggggggccagaccgcctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgtgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggcggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatcttta

SEQ ID NO: 291384 - DNA, 4602 bp, Homo sapiens
ggggagatacggaattcctctttcatggggaataatttcaatctccgatccccatcacaaatggggttcaacgcggttactcccccccgccggcgtagggtagtcacacgctgagccagtcagtgtcgcgcccggcctctgtgaacttagttttctcatctataaaatggggatcactctgagtccatggcggggctaggatctgaatccaattccctgattctggagtgtgtgccctgaacactgcagtagagacttgcaggcagcagttacttgacactcatccctgattggttcggttgggttcaaacattggttcaaacatttcattatctgtctcttctgagcctgttgtatctggagcagagctgggcaggaggtggtaagcagaggctctggggcctcctagaccctttgcagagggaaccggagatgtcttccaagtccccaagtctggcaccacctcgtctcaatctcactttcccctccaggtctagcagacttggcctccatccacagggccttcttagcgcatgccctcttcgcacttactcccacttccctccccatccctcgatcctctgtccagaggtcccaagggcctgttcagaccctgaactctgcccagcagcccctcactctgtcctctaccagggcgccttccctggggctcctgctcatcctgcagtgcccctcccctcccaacccctgtgggggtgtcccatcactttccccagcacccacttcccacaggccttccctcctcccctgcctgctgacccggcagctcccgacagcacggccttgtttcccagggaacaatgcatctgtgtcacggacaacaatgtcctttcatgtcaggcgcactggccccggtgcacgccgggacgtggcacaaagggtgctttgtgcagctcagggatgtgagttcctggctttgccatgttggtgctgccgacccggggcctctgtccttgggtcccagttatgcaacagtcagtcgaggctgtggggctggcccaggggctttatctgtctccctctccaacttttgccaagttacccttctgggcttccgccagccaggagcccacactccctcagccctcccacacgctcctctcacctcctagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggacttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcagctcctaaatgtagagatgcctgtggctgagggggcctctctacctgtgtccccactcactccaggagcactggctttggtcacgtcttagcagcagggccttgctccgttgttcccttgccctggtggtgggggggccagaccgcctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgtgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggcggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggtttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttc

SEQ ID NO: 291385 - DNA, 4400 bp, Homo sapiens
ggggagatacggaattcctctttcatggggaataatttcaatctccgatccccatcacaaatggggttcaacgcggttactcccccccgccggcgtagggtagtcacacgctgagccagtcagtgtcgcgcccggcctctgtgaacttagttttctcatctataaaatggggatcactctgagtccatggcggggctaggatctgaatccaattccctgattctggagtgtgtgccctgaacactgcagtagagacttgcaggcagcagttacttgacactcatccctgattggttcggttgggttcaaacattggttcaaacatttcattatctgtctcttctgagcctgttgtatctggagcagagctgggcaggaggtggtaagcagaggctctggggcctcctagaccctttgcagagggaaccggagatgtcttccaagtccccaagtctggcaccacctcgtctcaatctcactttcccctccaggtctagcagacttggcctccatccacagggccttcttagcgcatgccctcttcgcacttactcccacttccctccccatccctcgatcctctgtccagaggtcccaagggcctgttcagaccctgaactctgcccagcagcccctcactctgtcctctaccagggcgccttccctggggctcctgctcatcctgcagtgcccctcccctcccaacccctgtgggggtgtcccatcactttccccagcacccacttcccacaggccttccctcctcccctgcctgctgacccggcagctcccgacagcacggccttgtttcccagggaacaatgcatctgtgtcacggacaacaatgtcctttcatgtcaggcgcactggccccggtgcacgccgggacgtggcacaaagggtgctttgtgcagctcagggatgtgagttcctggctttgccatgttggtgctgccgacccggggcctctgtccttgggtcccagttatgcaacagtcagtcgaggctgtggggctggcccaggggctttatctgtctccctctccaacttttgccaagttacccttctgggcttccgccagccaggagcccacactccctcagccctcccacacgctcctctcacctcctagctgggcttcgctgacttgaacctggccgagtttgcgggctcgggctccacggtgcgctgctgcctgctcgagggatatgacacgaagaacactcgccaggacaactccatccttaagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggacttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcagctcctaaatgtagagatgcctgtggctgagggggcctctctacctgtgtccccactcactccaggagcactggctttggtcacgtcttagcagcagggccttgctccgttgttcccttgccctggtggtgggggggccagaccgcctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgtgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggcggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggtttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttc

SEQ ID NO: 291386 - DNA, 3244 bp, Homo sapiens
tcgggtgggggtgagggggcggtgagcaagaaggaaactgaggggctggcttccttatgggtttgtaaacacacccctccctggccccctctgaaaatgaggaagcatcttggggaaagaaaccaatctggttgggagcgagatcacagcagagctacatgctgagccccgagagtccccgactccagggctgggcctgggctcggcagggaaaggagctgaccaggtttcctgacttcccactgccctcttggtcaccctcacatccctctgagcctcagtttcttcacctgtcaagtggggcaggatgcagtgactccctgccgaggtgaccgtgaggatggggtggcaccagccagtacggatgtgcccggaagggctctgcaggccccacagactctgatgcttactatctgtgtcactgtgggcaagggacttaccatcgctggggcacggttttagcccctttgcaacacagggctggttaacagtacctgcttgtgaaacacctccagaggcctggtccagtggagcgctcaggaaatggggtatcgagggggacatgctgacctgtctctcacctgcagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcagctcctaaatgtagagatgcctgtggctgagggggcctctctacctgtgtccccactcactccaggagcactggctttggtcacgtcttagcagcagggccttgctccgttgttcccttgccctggtggtgggggggccagaccgcctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgtgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggcggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggtttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttc

SEQ ID NO: 291387 - DNA, 2138 bp, Homo sapiens
cgcggccgctcgcgcgcagccccgcacctccgcccctgcctctgcctcctgggccatgccctgctgtttacatgccggtgaggtccccggccgctccgaacccctccgagccccggctccccgagggtgaagcccgccggcccgcgaactggactggtggatctctcagacctggggccccggactccgatctccgccgtctccgccaccatcagggcgggatccggctctggtgttttgaggagggggtgtggtgtagggaaaggaatcccgtccctctccaccttttttcgccttcggggcttcagactcagggaactcgctcatggctttcttgatgaagaagaagaaattcaaattccaaactactttcaccctggaggagctgactgcggttcccttcgtgaacggggtcctcttctgcaaggtccggctgctggatggaggggattttgtcagcttgtcgtcaagggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggacttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcagctcctaaatgtagagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatcttta

SEQ ID NO: 291388 - DNA, 510 bp, Homo sapiens
aaaccctgcccaccacctgctgtgccaggccccatgagccctcttccctctcctgcctgctgggttgagctctgtggtccttacacagggccggggtgagtgtgtggcttcaccatggagaagctcattgtctaggcctgtagctgatggcagtccgctcactctgccaggcgcagggctgagcccaggcctcaccttgctatgccctcccctctggtctgccaggcaggccttggttccatctctgtcctccacacagggaaactgggctcagagaggttagtggctttgccagagcccccaagccaggagggggcagagagacaggattggaatccaagcccttctgaggccagagccgaaaggctgcagggggccctgcgcctgggcaggctgtgggtggtcagggcatagctgattgctcccctcgccacaggtcaccattggtatgttcctgctctctggagatccctgcttcaagacgtgagtgctggcacaggcctagggagc

SEQ ID NO: 291389 - DNA, 385 bp, Homo sapiens
gggattctgcagtcaacttgctgcttgtgtctccctccctgtgcaggagctgaaaggcgggaaggcttattccaaggtaagaggggctgtgtgaaggggcagtgggatggaatggggggtggcatgggacaggcacaagggaagcctccagccccttttctgccacaagcaagaggcactcagccctacctgagatgtgttattttttagaaatatctttattgatggtctttgcactcaatataaaggcagcatatggttgttgcaatataaatggtacagaagtccacagagcaaaagggccagtttctgtcccctttcctctctccaggcctctttctgggaccccattattggatagattaagacctttccagaccttgta

SEQ ID NO: 291390 - DNA, 4091 bp, Homo sapiens
cgcggccgctcgcgcgcagccccgcacctccgcccctgcctctgcctcctgggccatgccctgctgtttacatgccggtgaggtccccggccgctccgaacccctccgagccccggctccccgagggtgaagcccgccggcccgcgaactggactggtggatctctcagacctggggccccggactccgatctccgccgtctccgccaccatcagggcgggatccggctctggtgttttgaggagggggtgtggtgtagggaaaggaatcccgtccctctccaccttttttcgccttcggggcttcagactcagggaactcgctcatggctttcttgatgaagaagaagaaattcaaattccaaactactttcaccctggaggagctgactgcggttcccttcgtgaacggggtcctcttctgcaaggtccggctgctggatggaggggattttgtcagcttgtcgtcaagggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggacttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcagctcctaaatgtagagatgcctgtggctgagggggcctctctacctgtgtccccactcactccaggagcactggctttggtcacgtcttagcagcagggccttgctccgttgttcccttgccctggtggtgggggggccagaccgcctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgtgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggcggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggtttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttc

SEQ ID NO: 291391 - DNA, 4645 bp, Homo sapiens
cgcggccgctcgcgcgcagccccgcacctccgcccctgcctctgcctcctgggccatgccctgctgtttacatgccggtgaggtccccggccgctccgaacccctccgagccccggctccccgagggtgaagcccgccggcccgcgaactggactggtggatctctcagacctggggccccggactccgatctccgccgtctccgccaccatcagggcgggatccggctctggtgttttgaggagggggtgtggtgtagggaaaggaatcccgtccctctccaccttttttcgccttcggggcttcagactcagggaactcgctcatggctttcttgatgaagaagaagaaattcaaattccaaactactttcaccctggaggagctgactgcggttcccttcgtgaacggggtcctcttctgcaaggtccggctgctggatggaggggattttgtcagcttgtcgtcaagggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggtgagtggctgcctggccctgcccccgtggcctcctccttcctcgggatcccccattgtgatgctcccctgcgtcgcccctgacaggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggtgaggcctactgcttggtgccccctggagaacagacctctcccggtggtgccttgaacctccgcttctttacctataacacagggaccgtaaggtccccacctcagagggttgggtggtgacgattccactagctgatggccctgaagggtgcagccatgcccggcgtgcagcaggttctgttcatggctgctcttgcggttttgtggatcagacaagagcacgatctgctaggtggccttaggaagctgacttacctgctcattgcctggcatcctcgtctataaaatcggctcatgatggcagctgcaccctattgtgcatgtgaggtttcagtgaagtacagcacggagcgcacagggacattctgagcgccgctgcggctgactggcattattgtcgtcgttctgtgcttgtacctgttactgccctgaccgttgtgacttgtccccccacgacctgacccaggcggaagaaggactcggtggagagccacccgacctgggtggacgacacgcggatcgatgcggatgccatcgtggagaagatcgtgcagagccaggacttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcagctcctaaatgtagagatgcctgtggctgagggggcctctctacctgtgtccccactcactccaggagcactggctttggtcacgtcttagcagcagggccttgctccgttgttcccttgccctggtggtgggggggccagaccgcctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgtgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggcggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggtttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttc

SEQ ID NO: 291392 - DNA, 3646 bp, Homo sapiens
gctcacctgtcgcctctggcccacagggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggacttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcagctcctaaatgtagagatgcctgtggctgagggggcctctctacctgtgtccccactcactccaggagcactggctttggtcacgtcttagcagcagggccttgctccgttgttcccttgccctggtggtgggggggccagaccgcctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgtgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggcggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggtttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttc

SEQ ID NO: 291393 - DNA, 4688 bp, Homo sapiens
ggggagatacggaattcctctttcatggggaataatttcaatctccgatccccatcacaaatggggttcaacgcggttactcccccccgccggcgtagggtagtcacacgctgagccagtcagtgtcgcgcccggcctctgtgaacttagttttctcatctataaaatggggatcactctgagtccatggcggggctaggatctgaatccaattccctgattctggagtgtgtgccctgaacactgcagtagagacttgcaggcagcagttacttgacactcatccctgattggttcggttgggttcaaacattggttcaaacatttcattatctgtctcttctgagcctgttgtatctggagcagagctgggcaggaggtggtaagcagaggctctggggcctcctagaccctttgcagagggaaccggagatgtcttccaagtccccaagtctggcaccacctcgtctcaatctcactttcccctccaggtctagcagacttggcctccatccacagggccttcttagcgcatgccctcttcgcacttactcccacttccctccccatccctcgatcctctgtccagaggtcccaagggcctgttcagaccctgaactctgcccagcagcccctcactctgtcctctaccagggcgccttccctggggctcctgctcatcctgcagtgcccctcccctcccaacccctgtgggggtgtcccatcactttccccagcacccacttcccacaggccttccctcctcccctgcctgctgacccggcagctcccgacagcacggccttgtttcccagggaacaatgcatctgtgtcacggacaacaatgtcctttcatgtcaggcgcactggccccggtgcacgccgggacgtggcacaaagggtgctttgtgcagctcagggatgtgagttcctggctttgccatgttggtgctgccgacccggggcctctgtccttgggtcccagttatgcaacagtcagtcgaggctgtggggctggcccaggggctttatctgtctccctctccaacttttgccaagttacccttctgggcttccgccagccaggagcccacactccctcagccctcccacacgctcctctcacctcctagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggtgagtggctgcctggccctgcccccgtggcctcctccttcctcgggatcccccattgtgatgctcccctgcgtcgcccctgacaggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggacttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcagctcctaaatgtagagatgcctgtggctgagggggcctctctacctgtgtccccactcactccaggagcactggctttggtcacgtcttagcagcagggccttgctccgttgttcccttgccctggtggtgggggggccagaccgcctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgtgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggcggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggtttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttc

SEQ ID NO: 291394 - DNA, 3092 bp, Homo sapiens
ctctagcaggatccttcccgactagcccgacagcagtcaagatctcggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggacttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcagctcctaaatgtagagatgcctgtggctgagggggcctctctacctgtgtccccactcactccaggagcactggctttggtcacgtcttagcagcagggccttgctccgttgttcccttgccctggtggtgggggggccagaccgcctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgtgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggcggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggtttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttc

SEQ ID NO: 291395 - DNA, 2010 bp, Homo sapiens
cgcggccgctcgcgcgcagccccgcacctccgcccctgcctctgcctcctgggccatgccctgctgtttacatgccggtgaggtccccggccgctccgaacccctccgagccccggctccccgagggtgaagcccgccggcccgcgaactggactggtggatctctcagacctggggccccggactccgatctccgccgtctccgccaccatcagggcgggatccggctctggtgttttgaggagggggtgtggtgtagggaaaggaatcccgtccctctccaccttttttcgccttcggggcttcagactcagggaactcgctcatggctttcttgatgaagaagaagaaattcaaattccaaactactttcaccctggaggagctgactgcggttcccttcgtgaacggggtcctcttctgcaaggtccggctgctggatggaggggattttgtcagcttgtcgtcaagggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggtgaggcctactgcttggtgccccctggagaacagacctctcccggtggtgccttgaacctccgcttctttacctataacacagggaccgtaaggtccccacctcagagggttgggtggtgacgattccactagctgatggccctgaagggtgcagccatgcccggcgtgcagcaggttctgttcatggctgctcttgcggttttgtggatcagacaagagcacgatctgctaggtggccttaggaagctgacttacctgctcattgcctggcatcctcgtctataaaatcggctcatgatggcagctgcaccctattgtgcatgtgaggtttcagtgaagtacagcacggagcgcacagggacattctgagcgccgctgcggctgactggcattattgtcgtcgttctgtgcttgtacctgttactgccctgaccgttgtgacttgtccccccacgacctgacccaggcggaagaaggactcggtggagagccacccgacctgggtggacgacacgcggatcgatgcggatgccatcgtggagaagatcgtgcagagccaggacttcacagatggcagcaacaccgagggtgagccgtgctgggctggtgggggcgaggccacctgcgacctgctgtcctcatccccaaatcctggctcctcctgcgacctgctgtccgcatccccaatcactggctcctcctgcgacatgctgtcctcatccccaattcctggctcctcctgcgacatgctgtcctcatccccaaa

SEQ ID NO: 291396 - DNA, 568 bp, Homo sapiens
ctctcaacagtgtatcttgggtgcttttttctgttctacattttgggctgtggtttcgttggtaaattttgtggttcaaatttcaaaagtaacttctctggaatatttgcactgaaattaacctttagtaactcggacgcagcagctgtagatgaatttttgacttcagttgatgcaattgcctatctgttacaggttttctggacaggtagtagtgtctttttctctgtcctttgctactgcccaggaacttcactttgcttcttttcactacaaggctggggacttaaatgtatgaaattcttagtctactctcctgcttatttctgaaatcactactgacatttttagcttgaaacacctaaaacttacaaccacattagtatgtccacttaaattattgttttaggttcaagctgaagaagaaatattagagagaaatctaactaactgtgaaaaagaaaataaaaggctacaagaaaggtgtggtctatataaaagtgaacttgaaattctgaaagagaaattaaggcagttaaaagaagaaaataacaacgaaaaagaaaaa

SEQ ID NO: 291397 - DNA, 1475 bp, Homo sapiens
cggccgcggcggcggcgaacactccctccgaaagagaagcgcagttctccaaagggtagggactctgggcggggctagcagtcctattccgcaaccgcctcagtctcggccccctcaggccaggcgtgagcgccgcccgcctctccccctgacggcctccggttcccatggcttcccccaccaatgggcatcatggcggtaattgtgggaaatgtagtcccgggcgggctccgctagtgggctcgggcgcgctcgccgaccacgatccccggcaagccccgcgccttcggcggcgcctcacgcagtctgcgccggggcggggcagtgaccgggtaggcgcgtcccaacggctcccgcggcggttcgaattctgtgctgccggggttcgctggttctccgagttgtgtccgaggcttccacgcgcaggggcccgggaaagggtcagaggcttcctaacgcagactcgagtgcgaagcgcgcagtcgccgggtgggtctctccccagcgacgatctgggtgaaatggaatctagttcatcagactactataataaagacaatgaagaggaaagtttgcttgcaaatgttgcttccttaagacatgaactgaagataacagaatggagtttgcagagtttaggggaagagttatccagtgttagtccaagtgaaaattctgattatgcccctaatccttcaaggtctgaaaagctaattttggatgttcagcctagccaccctggacttttgaattattcaccttatgaaaacgtctgtaaaatatctggtagcagcactgattttcaaaaaaagccaagagataagatgttttcatcttctgcccctgtggatcaggagattaaaagccttcgagagaaactaaataaacttaggcaacagaatgcttgtttggtcacacagaatcattccttaatgactaaatttgaatctattcactttgaattaacacagtcaagagcaaaagtttctatgcttgagtctgctcaacagcaggcagccagtgtcccaatcttagaagaacagattataaatttggaagcagaggtttcagctcaagataaagttttgagagaggcagaaaataagctggaacagagccagaaaatggtaattgaaaaggaacagagtttgcaggagtccaaagaggaatgtataaaattaaaggtggacttacttgaacaaaccaaacaaggaaaaagagctgaacgacaaaggaatgaagcactatataatgccgaagagctgagtaaagctttccaacaatataaaaaaaaagtggctgaaaaactggaaaaggttcaagctgaagaagaaatattagagagaaatctaactaactgtgaaaaagaaaataaaaggctacaagaaaggtgtggtctatataaaagtgaacttgaaattctgaaagagaaattaaggcagttaaaagaagaaaataacaacgaaaaagaaaaa

SEQ ID NO: 291398 - DNA, 1276 bp, Homo sapiens
cggccgcggcggcggcgaacactccctccgaaagagaagcgcagttctccaaagggtagggactctgggcggggctagcagtcctattccgcaaccgcctcagtctcggccccctcaggccaggcgtgagcgccgcccgcctctccccctgacggcctccggttcccatggcttcccccaccaatgggcatcatggcggtaattgtgggaaatgtagtcccgggcgggctccgctagtgggctcgggcgcgctcgccgaccacgatccccggcaagccccgcgccttcggcggcgcctcacgcagtctgcgccggggcggggcagtgaccgggtaggcgcgtcccaacggctcccgcggcggttcgaattctgtgctgccggggttcgctggttctccgagttgtgtccgaggcttccacgcgcaggggcccgggaaagggtcagaggcttcctaacgcagactcgagtgcgaagcgcgcagtcgccggaaatggaatctagttcatcagactactataataaagacaatgaagaggaaagtttgcttgcaaatgttgcttccttaagacatgaactgaagataacagaatggagtttgcagagtttaggggaagagttatccagatgttttcatcttctgcccctgtggatcaggagattaaaagccttcgagagaaactaaataaacttaggcaacagaatgcttgtttggtcacacagaatcattccttaatgactaaatttgaatctattcactttgaattaacacagtcaagagcaaaagtttctatgcttgagtctgctcaacagcaggcagccagtgtcccaatcttagaagaacagattataaatttggaagcagaggtttcagctcaagataaagttttgagagaggcagaaaataagctggaacagagccagaaaatggtaattgaaaaggaacagagtttgcaggagtccaaagaggaatgtataaaattaaaggtggacttacttgaacaaaccaaacaaggaaaaagagctgaacgacaaaggaatgaagcactatataatgccgaagagctgagtaaagctttccaacaatataaaaaaaaagtggctgaaaaactggaaaaggttcaagctgaagaagaaatattagagagaaatctaactaactgtgaaaaagaaaataaaaggctacaagaaaggtgtggtctatataaaagtgaacttgaaattctgaaagagaaattaaggcagttaaaagaagaaaataacaacgaaaaagaaaaa

SEQ ID NO: 291399 - DNA, 271 bp, Homo sapiens
agtaacgaagtgaagacagtgaaagagatcagacatggcaaaccggagaaacagaagtgcataatggagaagagatagataacctacttacggacagacaagcgaatacgaggaaagggaaagaaacggtgatgactccttgcattccctcccctcacaacaaagaactccactgtggggatgaagcgcttcttctagccactgctatcgctatttaagaaccctaaatctgtcacccataataaagctgatttgaagtgttaaaaatttt

SEQ ID NO: 291400 - DNA, 6704 bp, Homo sapiens
  misc_feature (3057)..(3057): n is a, c, g, or t
  misc_feature (4233)..(4233): n is a, c, g, or t
gccggccgcgtcgaccctgccccagtgagagctctgagggtccctgcctgaagagggacagggaccggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcccgctcccctagggctccccagctctccctctccattgacacccagcttcttgtgcacttgcctccctggcttcactggtgagagatgccaggccaagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactggctacaccggaggcagctgccagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggnttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctccctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacgcagcccctgggcaaggagaccgactccctcagtgctgggttngtggtggtcatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgttaaaaatttt

SEQ ID NO: 291401 - DNA, 6789 bp, Homo sapiens
  misc_feature (2969)..(2969): n is a, c, g, or t
  misc_feature (4145)..(4145): n is a, c, g, or t
gccggccgcgtcgaccctgccccagtgagagctctgagggtccctgcctgaagagggacagggaccggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcccgctcccctagggctccccagctctccctctccattgacacccagcttcttgtgcacttgcctccctggcttcactggtgagagatgccaggccaagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggnttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctccctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacgcagcccctgggcaaggagaccgactccctcagtgctgggttngtggtggtcatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggttagatgggacagagggcttcccacaaaacagtcaggcgcacgagagatggaaagtgcggtaacccgcaaagcctgaagggataggggccagtggtcgcgcaagtgaaggcagaaaggcccagtcctgtgggcgtggccttccctgatatcggccctggctcttctgtacaggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgttaaaaatttt

SEQ ID NO: 291402 - DNA, 4020 bp, Homo sapiens
  misc_feature (2969)..(2969): n is a, c, g, or t
gccggccgcgtcgaccctgccccagtgagagctctgagggtccctgcctgaagagggacagggaccggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcccgctcccctagggctccccagctctccctctccattgacacccagcttcttgtgcacttgcctccctggcttcactggtgagagatgccaggccaagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggnttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaaggcaagtgatcacaaatctgccttctctgttgccccctatgctgacaaggcaagaatacctcagttggaatcccagaagggactgtgggtgagcactgatgtggaaattattggaaaaagccatgccaagctcacagtgggaagtgtctctcagaagcagtcaaaggcaaggcaggatcagttgatagcatgaatggaattttcaaaaatcacaggcgttgcctaagggaaggtcaggagctccccaagctcaagctgcgtggtgggtggcctcagataggttattttaactctgtgtgtttgtatatgtatttatggacctcagatgcatggaattagactaatcttaagctttggttcctgatacactgacattggtttatgcctggtcttcttttattttattattctaacaatgtaacacccatgaacctaacccaagaatttcaatattaataataacttacatctacttaagtcctcctcctgtatcctgttccctctccagaggaagaggaagacatatgatcctatttctaaggagtaagataataatataacagccggccgggcacagtggctcacgcctgtaatcccagcactttgggaggccgaggcaggcggatcacctgaggtcgggcattcgagaccagcctgacaaacatggagaaaccctgtctctactaaaaatacaaattagctgggcgtggtggtgcatggctgtaatcccagctattgggaaggctgaggcaggagaattgcttgaacccgggaggcagaggttgcaa

SEQ ID NO: 291403 - DNA, 1723 bp, Homo sapiens
gccggccgcgtcgaccctgccccagtgagagctctgagggtccctgcctgaagagggacagggaccggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcccgctcccctagggctccccagctctccctctccattgacacccagcttcttgtgcacttgcctccctggcttcactggtgagagatgccaggccaagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccagttttaccaagtcacagactgtgtgagatcgacggcccagtgacaagcttcaagccccacgtggaacctactagagatccccgaatgtctgcccatctccatggagtccctggtcagatttctc

SEQ ID NO: 291404 - DNA, 388 bp, Homo sapiens
ccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaagtgagaatgaggagaaacccaggctcaggaaggggagtctctcctatggcgatatttacaatcagaaaagataagaaatactattgcagaagtcaaagataggggaaggagagaggggtgggaagcctgctggaaattttggagaccctgatggtcataattccgtgtaacctctacccacccattcctttccagggcactgaagccaaaggcagaagttgatgaggatggagt

SEQ ID NO: 291405 - DNA, 1731 bp, Homo sapiens
cggtggtctcctgggcaacgcttcccgcctttgagggaccagccggcccgaatagcccttcccccaaggccagaacccgtgggaaaccggaacccaggcgtctggcccccaactggggtaacaacctcccacgtcgtcccctagggaaaactgcgctgcactgggctgctgccgtgaacaacgcccgagccgcccgctcgcttctccaggccggagccgataaagatgcccaggacaacagggttagatgggacagagggcttcccacaaaacagtcaggcgcacgagagatggaaagtgcggtaacccgcaaagcctgaagggataggggccagtggtcgcgcaagtgaaggcagaaaggcccagtcctgtgggcgtggccttccctgatatcggccctggctcttctgtacaggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgttaaaaatttt

SEQ ID NO: 291406 - DNA, 6616 bp, Homo sapiens
  misc_feature (2969)..(2969): n is a, c, g, or t
  misc_feature (4145)..(4145): n is a, c, g, or t
gccggccgcgtcgaccctgccccagtgagagctctgagggtccctgcctgaagagggacagggaccggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcccgctcccctagggctccccagctctccctctccattgacacccagcttcttgtgcacttgcctccctggcttcactggtgagagatgccaggccaagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggnttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctccctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacgcagcccctgggcaaggagaccgactccctcagtgctgggttngtggtggtcatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgttaaaaatttt

SEQ ID NO: 291407 - DNA, 1558 bp, Homo sapiens
cggtggtctcctgggcaacgcttcccgcctttgagggaccagccggcccgaatagcccttcccccaaggccagaacccgtgggaaaccggaacccaggcgtctggcccccaactggggtaacaacctcccacgtcgtcccctagggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgttaaaaatttt

SEQ ID NO: 291408 - DNA, 1525 bp, Homo sapiens
ctcctcatagcttatgggtggtggcggctgggctgaagacggcggacaggacatcccgcccggccgcctgtggtcaccctcccgcgcaggcgctctcctggaagacccagcacctggagttccgattggctctgcgtgaggggcgggcctttgcgacatcttggggggcgccttcggtgacgtcacaggggcgggccttctgtcacgtcacaagggctgtacagtgcctggagctgggcagtcttctcagagtggagcctggtaaccgcgacctccccgccagttcctgtgtgttgctggctggaaaggggtagttgacaaactcccacccagcacagtatttatgtcggtcaaaaatggaaaactatgtgtccgggcgtggccaggaaggaggatcccttcaggccaagagcagcctagcaatatggcgcaaccccacctctgtagtccaacctcagcctcccagctacttgaaccccaagattcaaggctccaatgatctgtgatctcaccacagcactcctgcctgcgagactgagagaccaaagaccaacgaactaccacagctggcagttccggaacctgccaatgatgggcaatggaaagtgagggagttcaactctgttttcagagaaatggaataatcatatcgctgatctatgtaaacaagttgaagaattgtctgacagaaaatacgtttcgcttttgttgttctggctggagtgcaatggcgcaatctcggctcaccgcaacctccgcctcccaggttcaagcgattctcctgcctcaacctccagagtagctaggactacaggtgtgcaccaccacgcgcagacatgaacttgtgaattcaacaagtgaagatttacaacttgataaaccagctgcaggagtaaaggaagaatggtatgccagaatcactaaatgaagaaagatggtggatcagcttttctgcaaaaaaatttgctgaggccttggggagcgctgaggccttggggagcactgaagccaaggctctactgtaccaaaaatttgaaggccatgcgaatgatctgtatgtggaaggactaccagaaaacattcctttcagaagtccctcgtggtatggaatcgcaaggctggaaaacatcattcaagtgggcaatcgaattaaatttcttattaaaagtaactccagtcaaactccattgtctccaagtcgactttcgtcctcacccacaactcctccacacaagccctgaacatgtgtccatgtttctcctatttacctcaagcacgtatggagtgaattcttaccttttaatattgccatggcattcacattgaatgtaagttgaactctctcatatggtagctgggttcagattcccttgacaatttccagttctaaccctcacagttcctcagtgtggctggcccagatactgaccctacacagttgcctccccctggtgactacccgccatggaaccgttggatacaatctgcatgactcaccccacagacctcacagcccacttggaca

SEQ ID NO: 291409 - DNA, 570 bp, Homo sapiens
gcaaatctacttctaggtatctacccaaaggtactgaaagcaaggactggaacagatgtctgtataccaatgttccaggtgtggaaagggaagggaccatatttcatccccgtgtgcgcccagccctggcccagaagtctctcaatcgctactgagtgaatgcacgaagccgctccattagcccagttctcagtgagctcttcaccatacagttgatagtttgcttctataccctagaatgctgttctccaattgcttctgctcatcaaatctcctctcccgacacttcagaaattccctgaggatccagattacatttccaacactttcattcacataacactgtctgggacccagcaaactctcaaatgtccgctctacttactcccagtgaaatacatttcgttttcccgccgctgaagatgtcactcagggtctgccaacacgatgccacaagtacccaagaggagcagctcaaaagcatgatcaggattcaaagcatcagtttaatcttaggcattgagaaatgctaaatgtcacataccattaataaataaatcttaaacagcc

SEQ ID NO: 291410 - DNA, 3358 bp, Homo sapiens
gagaagtgtgggctacccggccactgccctggagctgtggtgactgctgcgtttttctcccatgcacttgcacgtccaggactcctgggagaacttgggccacactccttccttgccctcttgagctcattcgtcaccctgttgggtgagcacagccctagctcaggccactgggcaagccacaccatccaaagaggaggtcctctgccccaggacccccacaccaccccagctccctgttttgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcaggaatgatgctgggtggtggctgtgggcaggagctggcccactggatcatccatgggcgcccggagaaggacatgcatggctatgacatcaggcgcttccatcactcgctcacggaccacccccgctggatccgagagcgaagccatgagtcctacgccaagaactactccgtcgtcttcccccacgatgagccgctggccgggcgcaacatgaggagagacccgctgcatgaggaactccttggacaaggctgcgtgttccaggagcggcatggctgggagcgaccgggatggtttcatccccgaggcccagctccggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacgtgcatgctcaaccaccatgggggcaccgagagtgacctgactgtcagccgcctggcacccagccaccaggcctccccgctggcccccgcctttgaaggggacggttactacctggccgtgggcggggccgtggcccagcacaactggtcccacatcaccaccgtgctgcaggaccagaagtcccagtgccagctcatcgacagctccgaggacctgggtatgatcagtatccagggcccagccagccgagccattttgcaggaggtgctggacgcagacctgagcaacgaggccttcccgttctccacccacaagctactgagagccgcagggcacctggtccgagccatgcggctgtcctttgtcggggagctgggctgggagctgcacattccaaaggcgtcctgcgtgcctgtgtaccgggctgtgatggccgcgggtgccaagcacggcctcatcaacgcagggtaccgcgccattgactccctgagcattgagaaaggctaccggcactggcacgcggacctgcggccagacgacagccccctggaggcaggcctggccttcacctgcaagctcaagtcgccggtgcccttcctggggagggaggccctggagcagcagcgggccgcaggcctccgccggcgcctggtgtgcttcaccatggaggacaaagtacccatgtttggcctggaggccatctggaggaacggccaagtggtgggccatgtccggagggctgactttgggttcgccatcgacaagaccatcgcctacggttacatccatgaccccagcggtgggccggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagcctaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggcttgtagccctttccaagcttctagaaggtgcttagtaaatacttgataagccccacgtgaaaacaaaaaaaaa

SEQ ID NO: 291411 - DNA, 1475 bp, Homo sapiens
cctggagttccggccaggccactgcttgggaagcaagaaggtgaaggcacctctgctgggccaagcactcttagggccgaggggcactgcagctgacaagagctccctgttttgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcagggaaggtccagacagtcctgccactcctgtttaccgtcaacgtctatctgtatctgtaggtcaggaggacaaacataggtcaataaatatgtaatgttagtgaacg

SEQ ID NO: 291412 - DNA, 2384 bp, Homo sapiens
cctggagttccggccaggccactgcttgggaagcaagaaggtgaaggcacctctgctgggccaagcactcttagggccgaggggcactgcagctgacaagagctccctgttttgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcaggaatgatgctgggtggtggctgtgggcaggagctggcccactggatcatccatgggcgcccggagaaggacatgcatggctatgacatcaggcgcttccatcactcgctcacggaccacccccgctggatccgagagcgaagccatgagtcctacgccaagaactactccgtcgtcttcccccacgatgagccgctggccgggcgcaacatgaggagagacccgctgcatgaggaactccttggacaaggctgcgtgttccaggagcggcatggctgggagcgaccgggatggtttcatccccgaggcccagctccggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacgtgcatgctcaaccaccatgggggcaccgagagtgacctgactgtcagccgcctggcacccagccaccaggcctccccgctggcccccgcctttgaaggggacggttactacctggccgtgggcggggccgtggcccagcacaactggtcccacatcaccaccgtgctgcaggaccagaagtcccagtgccagctcatcgacagctccgaggacctgggtatgatcagtatccagggcccagccaggtgagagaggactgggagcccgcccctgggtgcacctgctgcctggacccaggtcctccaacaggcccttgggcagaacagcttgtccagaatgggccattctgaatagttaagcgctctggtaaaccagagatgccattctgaataaatatcttcaaagcactggaatgcagataagccggt

SEQ ID NO: 291413 - DNA, 1598 bp, Homo sapiens
cctggagttccggccaggccactgcttgggaagcaagaaggtgaaggcacctctgctgggccaagcactcttagggccgaggggcactgcagctgacaagagctccctgttttgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggcagtcaaatacagacccagggcagctggagggctttgcctcaaaacatccacagagaaggtctgcgcagtgtggagtgatgacctcagaagggcatgagagcacacaagtcctacgtccttcagcaaatgacactgccctcccaaccagctgctgcagcggcatttcccctggcctgggctgtttcccgggcagcttctggggttagggcagccctgcagccctgttctatgtgtatatgcatttagtccacacatggaacgactgagtggctactttgggctaaaaactgctttaatttctggagaaagagggaagctaagataaaagtccctgactctgggtgcctatattttggtggagagacatacaataaacaaacaaatggctgggcacggtggctcacacctgtaatcccagcactttgggaggctgaggtgggcgga

SEQ ID NO: 291414 - DNA, 854 bp, Homo sapiens
aacagcaaagtccactcctggttttgatgttttctattcatcccttttactcactcgaagcccgagccctgctgtccaggccaggtgctgggctggctctggggaccagcgtagtcctagtaggccagccctatctgcctggagccacggttgggtgtgcatcatgcagccccccattctcctccaggccgctgtggacgcgtccccaccctgcggtttctggggccccagctttctctactgcttcttccagcaaagtacccatgtttggcctggaggccatctggaggaacggccaagtggtgggccatgtccggagggctgactttgggttcgccatcgacaagaccatcgcctacggttacatccatgaccccagcggtgggccggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagcctaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggcttgtagccctttccaagcttctagaaggtgcttagtaaatacttgataagccccacgtgaaaacaaaaaaaaa

SEQ ID NO: 291415 - DNA, 1724 bp, Homo sapiens
gagaagtgtgggctacccggccactgccctggagctgtggtgactgctgcgtttttctcccatgcacttgcacgtccaggactcctgggagaacttgggccacactccttccttgccctcttgagctcattcgtcaccctgttgggtgagcacagccctagctcaggccactgggcaagccacaccatccaaagaggaggtcctctgccccaggacccccacaccaccccagctccctgttttgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagagtttcactttgttgcccacactggagtacagtggcacagtgtcagctcactgcaacctccgcctcccgggttcaagcaattctcgtgcctcagcctcccatgtagctgggattaaatgtgcccgtcaccacacccggctgatttttttttgtattttagtagagacggagtttcaccatgttgccaaggctggtctcgaactcctgagctcaggcaatccacccatctcggacttccaaagtgctaggattacaggcgtgagccaccatgcttagctgattatgtaaacattgttaatacctgagcaagtagtgtccaactttttgtgtttcttggagttattaacagtttttgtcccagctgctcagtttcttttgtaactgttatgtgtgtgtgtgtaacattatcttcgtgccccaagacccatacccgttatcaatcactccccatttcccaccctgtccccagacttaggcaatcccaaatctgatttctgcctcgatggagtttcctattctggacgtttagtataaatggaatcacatg

SEQ ID NO: 291416 - DNA, 3228 bp, Homo sapiens
cctggagttccggccaggccactgcttgggaagcaagaaggtgaaggcacctctgctgggccaagcactcttagggccgaggggcactgcagctgacaagagctccctgttttgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcaggaatgatgctgggtggtggctgtgggcaggagctggcccactggatcatccatgggcgcccggagaaggacatgcatggctatgacatcaggcgcttccatcactcgctcacggaccacccccgctggatccgagagcgaagccatgagtcctacgccaagaactactccgtcgtcttcccccacgatgagccgctggccgggcgcaacatgaggagagacccgctgcatgaggaactccttggacaaggctgcgtgttccaggagcggcatggctgggagcgaccgggatggtttcatccccgaggcccagctccggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacgtgcatgctcaaccaccatgggggcaccgagagtgacctgactgtcagccgcctggcacccagccaccaggcctccccgctggcccccgcctttgaaggggacggttactacctggccgtgggcggggccgtggcccagcacaactggtcccacatcaccaccgtgctgcaggaccagaagtcccagtgccagctcatcgacagctccgaggacctgggtatgatcagtatccagggcccagccagccgagccattttgcaggaggtgctggacgcagacctgagcaacgaggccttcccgttctccacccacaagctactgagagccgcagggcacctggtccgagccatgcggctgtcctttgtcggggagctgggctgggagctgcacattccaaaggcgtcctgcgtgcctgtgtaccgggctgtgatggccgcgggtgccaagcacggcctcatcaacgcagggtaccgcgccattgactccctgagcattgagaaaggctaccggcactggcacgcggacctgcggccagacgacagccccctggaggcaggcctggccttcacctgcaagctcaagtcgccggtgcccttcctggggagggaggccctggagcagcagcgggccgcaggcctccgccggcgcctggtgtgcttcaccatggaggacaaagtacccatgtttggcctggaggccatctggaggaacggccaagtggtgggccatgtccggagggctgactttgggttcgccatcgacaagaccatcgcctacggttacatccatgaccccagcggtgggccggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagcctaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggcttgtagccctttccaagcttctagaaggtgcttagtaaatacttgataagccccacgtgaaaacaaaaaaaaa

SEQ ID NO: 291417 - DNA, 2025 bp, Homo sapiens
ggggggaggcacctgagctcccccatcagggcttgtggtcgggcgtgaaggattcagggccgcagaccgtggacttgattcctgtcttctccagcacggggacccctgatgggggaggcacctgagctccgagggttcttcctgggctgtggcttcaacagcgcaggaatgatgctgggtggtggctgtgggcaggagctggcccactggatcatccatgggcgcccggagaaggacatgcatggctatgacatcaggcgcttccatcactcgctcacggaccacccccgctggatccgagagcgaagccatgagtcctacgccaagaactactccgtcgtcttcccccacgatgagccgctggccgggcgcaacatgaggagagacccgctgcatgaggaactccttggacaaggctgcgtgttccaggagcggcatggctgggagcgaccgggatggtttcatccccgaggcccagctccggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacgtgcatgctcaaccaccatgggggcaccgagagtgacctgactgtcagccgcctggcacccagccaccaggcctccccgctggcccccgcctttgaaggggacggttactacctggccgtgggcggggccgtggcccagcacaactggtcccacatcaccaccgtgctgcaggaccagaagtcccagtgccagctcatcgacagctccgaggacctgggtatgatcagtatccagggcccagccagccgagccattttgcaggaggtgctggacgcagacctgagcaacgaggccttcccgttctccacccacaagctactgagagccgcagggcacctggtccgagccatgcggctgtcctttgtcggggagctgggctgggagctgcacattccaaaggcgtcctgcgtgcctgtgtaccgggctgtgatggccgcgggtgccaagcacggcctcatcaacgcagggtaccgcgccattgactccctgagcattgagaaaggctaccggcactggcacgcggacctgcggccagacgacagccccctggaggcaggcctggccttcacctgcaagctcaagtcgccggtgcccttcctggggagggaggccctggagcagcagcgggccgcaggcctccgccggcgcctggtgtgcttcaccatggaggacaaagtacccatgtttggcctggaggccatctggaggaacggccaagtggtgggccatgtccggagggctgactttgggttcgccatcgacaagaccatcgcctacggttacatccatgaccccagcggtgggccggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagcctaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggcttgtagccctttccaagcttctagaaggtgcttagtaaatacttgataagccccacgtgaaaacaaaaaaaaa

SEQ ID NO: 291418 - DNA, 852 bp, Homo sapiens
gggctgccgtggccacacactgtgtccccagcctcgaaggaacaaacccaaaactatcgcagccacatcatctccggtcccaggcgctggattgggcagccgctccccagacacagctgggattttcccccagagactctgtacctcttgggtccctggtctgacccacagacgaggcccagctttgggatcacagacttggggaggcctgatgggacaggcggccacccttgcccccactcccctgctggcgggtggaaaggggggttccttgatgaggagggggacactggtgttctgacgcatcaccaggctaaacttcaaagacccttcacatggaccctccccagagcattctggggatctgagcccatccctcccaggggccgctccctccccagtcatgtaggggcaccccaggactccccagcactggaacctaggcagcagacagcaatgtgtggagagcgaggccggagtcccatgtccctgtgggggatgagagcctcagctgggccctctgtccacaacgcccactcactgagggccactggggtggggtggctctgggggagaaagctgagttcacccaagggtggggcgaatggagagtcaggggcccgctcaatgctgagccacaaaggggactctggtgcaggggaccggggtccaggcttaccctgggtcctaggctagcccttccctgacgggccatccccaaagcagtgacccgtccccctgtctgcggcaggcgcttccatcactcgctcacggaccacccccgctggatccgagagcgaagccatgagtcctacgccaagaactactccgtcgtcttcccccacgatgagc

SEQ ID NO: 291419 - DNA, 3689 bp, Homo sapiens
gccgcagtagctggggccaccctcgggaaggaagagtctgtcgcgagcgcgagcttctgagctcgacgggccgagctggcagctggttggtgcttacaccttggccgcagcggcaggtccttccacgtgctttcggcggcgacatggagctggaggagttggggatccgagaggaatgtggcgtgttcgggtgcatcgcctcaggagagtggcccacgcagctggatgtaccgcatgtgatcactctgggactcgtggggctgcagcaccggggtcaggagagtgctggtattgtgactagtgatgggagttcggtgccaacattcaaatcacacaagggaatgggtcttgtaaatcacgtctttactgaagacaatttgaaaaaattatatgtttcaaatcttggaattggacacaccaggtatgccaccacaggaaaatgtgaactagaaaattgtcagcccttcgttgttgaaacacttcatgggaagatagctgtggcacataatggcgaattggtaaatgctgctcgattaaggaaaaagcttctgcgtcatggtattggtctgtctacaagttctgatagtgaaatgattacccagttactggcgtatacccctcctcaggaacaagatgacaccccagactgggtagccaggattaaaaacttgatgaaggaagcacccacagcatactccctgcttataatgcacagagatgttatttatgcagtacgagatccttatggaaatcgtcccttatgcattggtcgtcttattccagtgtctgatataaatgacaaagagaaaaaaacatcagaaacagaaggatgggtggtgtcttcagaatcttgtagcttcttatctattggtgcaagatattaccgtgaagtcttgcctggagaaattgtggaaatatccagacacaatgtccaaactcttgatattatatcaaggtctgaaggaaacccagtggctttttgtatctttgaatatgtttattttgcaagaccagacagtatgttcgaagaccaaatggtttatacagtaagataccgttgtggccagcagctagcgattgaagcacctgtggatgcagatttggttagcactgttccagaatctgctacgcctgctgctcttgcttacgcaggaaagtgtggacttccatatgtggaggtgctgtgtaaaaaccggtatgtagggagaaccttcattcagccaaacatgaggttaagacaacttggtgttgcaaaaaaatttggagtattgtcagacaactttaaaggcaaaagaattgttcttgtagatgattcaattgtcagaggcaataccatctcacctataataaaactgctcaaagaatctggtgcaaaagaggtacacattcgagtagcttcaccaccaattaaatatccatgcttcatgggaataaacattcctacaaaagaagagctcattgccaataaaccagaatttgatcaccttgcagaatatctaggagcaaacagtgttgtgtatctgtcagtagaaggactggtttcatctgtacaagaagggataaagtttaaaaaacagaaagagaaaaagcacgatattatgatccaagaaaatggaaatggtctggaatgttttgaaaagagtggtcattgtacagcttgtctcactggaaaatatcctgtagaattagaatggtagctggtagggttggatgtgtgtagtttcaagatagaaagttggtcaagaagttatagtggtcacacctcatctatttactgttactcagttggtacaatgtaaaatgccatgcttatgtttataagttttgagatttttttttttttctgaaaaggataccaaagtgcgataactgaacatttccaattgcatataatacaacaatatgtggtgttcttttttttacacaagcattggctagcctttttaacctggtcagagaaggcaggtggtcactgacatttcccaagtccatgctttaaagggtttgcaagaagttagggttaaggagaggtgatgccaacaagacaggtgagttaaatataccatttcacacaaagtttgaatagaatacattatacctcataggtgtctagcctctacagttctggctgtagttatgaccttggcttccctgtctaactgtagacaaatctttaaaaaaaaataataataatctggtgcctcagtttccccacatgtgcaatgggatacttattaaataattaataagaatgtgaataagtgtcatacttttgtgatttgagccatcatttcacttctgattttaagacaactcatgattgttagctttcagaaagctaatgattgttaactttttgaaattagtttacaattaattaagatttcattatgatggaaggagacataattggcagatctttgccatctctctttgagatgtcctaaaaagggttgtaaaaatctgtgaaaaagtttttcctacatttgactagaaaatgtgatccatagtatttagtgccctgatactataagctcagcaagtaacctggtacatttgaaataaaaaccaaatttttagattcaaacaatccctttatccttaatttaattaattatcatatgctttttttaatgaagtgcttgatcacttgcaaacatatatacatgtagatgtacatatacatgtacacatacacataaatattattgcaattaagtgatcaagtacagacacaataggggccagttttgtttaaggatcaaagagacaaccactttggggaattagtatcaacttacaatccaagtccaagtatcatcttataatcacttttttctactatattaagatctaatgaatttgatttcttttttgaagttttttcttgtaacatctgagattagaagtttaagatgacttgaccccaaacctttgtttatgtaagaatttttaaacataaaagtgtttgtttctgttatgttaccataatttgatgtatatagtgtccagatccatttagaaatttaatatttattaataactgaaactgtttgtcttcctttggtatatagtctcgcatattatattatagcaggccaagataaaattttgacagctctttaagcccacatgcagcagtgggtcagataaccctgtggcagtgacacgggcaaattggcatttgaataaagccctgggaccacctcaacatgcgtagcctcttgtcttaaatgtactccccatggcagcatggaggaggcaagacctgtgggtcaattttgaactggccttactttgatttttaaaacaagagactcagggaaagtactaaaccaaaatctctgattttactttgcgttttctgtagtttttgttttactgagatgcttttgtaaaggaaaataatactgtgacagtttagtaattctacagattcttaatatttctccatcatggccttttacttcacaattttctgaagtctgaattcaattacaattttttttttaccaatttaatctcaaatgttgtttaactgctttaaattcatatacgtagagtattataaactgcagagatgaaaaatgtgttttcacgggatttatattgtgaactaaactaagcctactttttgtgacttatttgtgatgccttgttgataaatatgtgtaataagtatgtttaaa

SEQ ID NO: 291420 - DNA, 649 bp, Homo sapiens
ttgctaagcgtcgccgagttgggagtgtcttcagccctaaggcagcatcagagatcataatcttctgctctcgtggcaagaaatttgtgcggatagagttgatacacctcacttgaagttggcctggagaaaagaggcgtcggactcctggacggggttgggaaacggtcaccagtttcggctcaaagcagcctgtttccaggagaccgccatggtcgaggcagcgtcctggtcccacggtgcggggccggacgatcatttatgggatataaataaaaggactatgaggtggtaaataaaagactaccaactagaagccatagggagtcatttgaaggagaaataggcacggctcatctgtggttgagggaaagggatcttgaaagatgattaggagaacttgggttctggggaaagtgcgggaagacattctggcagagaagcaaacgtgaggaaaggtaagaaggcaagaatctcccattacaaagggtttggtgaaaccctttgcctgtccttttcgctcccttcgggagcagtcggcaataagctggaagggtaatggggtgaaaatgcccgtggtcagttccctggctctgcgactcactagatgtctgacaataaacaagttacttagcttctgggaaactgt

SEQ ID NO: 291421 - DNA, 3829 bp, Homo sapiens
gccgcagtagctggggccaccctcgggaaggaagagtctgtcgcgagcgcgagcttctgagctcgacgggccgagctggcagctggttggtgcttacaccttggccgcagcggcaggtccttccacgtgctttcggcggcgacatggagctggaggagttggggatccgagaggaatgtggcgtgttcgggtgcatcgcctcaggagagtggcccacgcagctggatgtaccgcatgtgatcactctgggactcgtggggctgcagcaccggggtcaggagagtgctggtattgtgactagtgatgggagttcggtgccaacattcaaatcacacaagggaatgggtcttgtaaatcacgtctttactgaagacaatttgaaaaaattatatgtttcaaatcttggaattggacacaccaggtatgccaccacaggaaaatgtgaactagaaaattgtcagcccttcgttgttgaaacacttcatgggaagatagctgtggcacataatggcgaattggtaaatgctgctcgattaaggaaaaagcttctgcgtcatggtattggtctgtctacaagttctgatagtgaaatgattacccagttactggcgtatacccctcctcaggaacaagatgacaccccagactgggtagccaggattaaaaacttgatgaaggaagcacccacagcatactccctgcttataatgcacagagatgttatttatgcagtacgagatccttatggaaatcgtcccttatgcattggtcgtcttattccagtgtctgatataaatgacaaagagaaaaaaacatcagaaacagaaggatgggtggtgtcttcagaatcttgtagcttcttatctattggtgcaagatattaccgtgaagtcttgcctggagaaattgtggaaatatccagacacaatgtccaaactcttgatattatatcaaggtctgaaggaaacccagtggctttttgtatctttgaatatgtttattttgcaagaccagacagtatgttcgaagaccaaatggtttatacagtaagataccgttgtggccagcagctagcgattgaagcacctgtggatgcagatttggttagcactgttccagaatctgctacgcctgctgctcttgcttacgcaggaaagtgtggacttccatatgtggaggtgctgtgtaaaaaccggtatgtagggagaaccttcattcagccaaacatgaggttaagacaacttggtgttgcaaaaaaatttggagtattgtcagacaactttaaaggcaaaagaattgttcttgtagatgattcaattgtcagaggcaataccatctcacctataataaaactgctcaaagaatctggtgcaaaagaggtacacattcgagtagcttcaccaccaattaaatatccatgcttcatgggaataaacattcctacaaaagaagagctcattgccaataaaccagaatttgatcaccttgcagaatatctaggagcaaacagtgttgtgtatctgtcagtagaaggactggtttcatctgtacaagaagggataaagtttaaaaaacagaaagagaaaaagcacgatattatgatccaagaaaatggaaatggtctggaatgttttgaaaagagtggtcattgtacagcttgtctcactggaaaatatcctgtagaattagaatggtagctggtagggttggatgtgtgtagtttcaagatagaaagttggtcaagaagttatagtggtcacacctcatctatttactgttactcagttggtacaatgtaaaatgccatgcttatgtttataagttttgagatttttttttttttctgaaaaggataccaaagtgcgataactgaacatttccaattgcatataatacaacaatatgtggtgttcttttttttacacaagcattggctagcctttttaacctggtcagagaaggcaggtggtcactgacatttcccaagtccatgctttaaagggtttgcaagaagttagggttaaggagaggtgatgccaacaagacaggtgagttaaatataccatttcacacaaagtttgaatagaatacattatacctcataggtgtctagcctctacagttctggctgtagttatgaccttggcttccctgtctaactgtagacaaatctttaaaaaaaaataataataatctggtgcctcagtttccccacatgtgcaatgggatacttattaaataattaataagaatgtgaataagtgtcatacttttgtgatttgagccatcatttcacttctgattttaagacaactcatgattgttagctttcagaaagctaatgattgttaactttttgaaattagtttacaattaattaagatttcattatgatggaaggagacataattggcagatctttgccatctctctttgagatgtcctaaaaagggttgtaaaaatctgtgaaaaagtttttcctacatttgactagaaaatgtgatccatagtatttagtgccctgatactataagctcagcaagtaacctggtacatttgaaataaaaaccaaatttttagattcaaacaatccctttatccttaatttaattaattatcatatgctttttttaatgaagtgcttgatcacttgcaaacatatatacatgtagatgtacatatacatgtacacatacacataaatattattgcaattaagtgatcaagtacagacacaataggggccagttttgtttaaggatcaaagagacaaccactttggggaattagtatcaacttacaatccaagtccaagtatcatcttataatcacttttttctactatattaagatctaatgaatttgatttcttttttgaagttttttcttgtaacatctgagattagaagtttaagatgacttgaccccaaacctttgtttatgtaagaatttttaaacataaaagtgtttgtttctgttatgttaccataatttgatgtatatagtgtccagatccatttagaaatttaatatttattaataactgaaactgtttgtcttcctttggtatatagtctcgcatattatattatagcaggccaagataaaattttgacagctctttaagcccacatgcagcagtgggtcagataaccctgtggcagtgacacgggcaaattggcatttgaataaagccctgggaccacctcaacatgcgtagcctcttgtcttaaatgtactccccatggcagcatggaggaggcaagacctgtgggtcaattttgaactggccttactttgatttttaaaacaagagactcagggaaagtactaaaccaaaatctctgattttactttgcgttttctgtagtttttgttttactgagatgcttttgtaaaggaaaataatactgtgacagtttagtaattctacagattcttaatatttctccatcatggccttttacttcacaattttctgaagtctgaattcaattacaattttttttttaccaatttaatctcaaatgttgtttaactgctttaaattcatatacgtagagtattataaactgcagagatgaaaaatgtgttttcacgggatttatattgtgaactaaactaagcctactttttgtgacttatttgtgatgccttgttgataaatatgtgtaataagtatgtttaaaaaaaaaagaggcagaataaaagagaaggaggaagacaggagacgggaaacaggaaaagaaggagaaagagaaaggaaaagagaagagaaaaaaagaggaggagaaaagaaagaacgagaaaacaaatgaagaacaaaaga

SEQ ID NO: 291422 - DNA, 3366 bp, Homo sapiens
tcatccccaaatcatcccctgtccctggtccatggaaaaattgtcttccaccaaactggtccctggtgccaaaaaggttggggactgctgcattagtgggatgcaggatttttgtaactggacatccacagaatgccttattttcattatggttggctactgggtttggggtggggtggagcttcccctctgatgattaaacttctctttttttctatatagcttctgcgtcatggtattggtctgtctacaagttctgatagtgaaatgattacccagttactggcgtatacccctcctcaggaacaagatgacaccccagactgggtagccaggattaaaaacttgatgaaggaagcacccacagcatactccctgcttataatgcacagagatgttatttatgcagtacgagatccttatggaaatcgtcccttatgcattggtcgtcttattccagtgtctgatataaatgacaaagagaaaaaaacatcagaaacagaaggatgggtggtgtcttcagaatcttgtagcttcttatctattggtgcaagatattaccgtgaagtcttgcctggagaaattgtggaaatatccagacacaatgtccaaactcttgatattatatcaaggtctgaaggaaacccagtggctttttgtatctttgaatatgtttattttgcaagaccagacagtatgttcgaagaccaaatggtttatacagtaagataccgttgtggccagcagctagcgattgaagcacctgtggatgcagatttggttagcactgttccagaatctgctacgcctgctgctcttgcttacgcaggaaagtgtggacttccatatgtggaggtgctgtgtaaaaaccggtatgtagggagaaccttcattcagccaaacatgaggttaagacaacttggtgttgcaaaaaaatttggagtattgtcagacaactttaaaggcaaaagaattgttcttgtagatgattcaattgtcagaggcaataccatctcacctataataaaactgctcaaagaatctggtgcaaaagaggtacacattcgagtagcttcaccaccaattaaatatccatgcttcatgggaataaacattcctacaaaagaagagctcattgccaataaaccagaatttgatcaccttgcagaatatctaggagcaaacagtgttgtgtatctgtcagtagaaggactggtttcatctgtacaagaagggataaagtttaaaaaacagaaagagaaaaagcacgatattatgatccaagaaaatggaaatggtctggaatgttttgaaaagagtggtcattgtacagcttgtctcactggaaaatatcctgtagaattagaatggtagctggtagggttggatgtgtgtagtttcaagatagaaagttggtcaagaagttatagtggtcacacctcatctatttactgttactcagttggtacaatgtaaaatgccatgcttatgtttataagttttgagatttttttttttttctgaaaaggataccaaagtgcgataactgaacatttccaattgcatataatacaacaatatgtggtgttcttttttttacacaagcattggctagcctttttaacctggtcagagaaggcaggtggtcactgacatttcccaagtccatgctttaaagggtttgcaagaagttagggttaaggagaggtgatgccaacaagacaggtgagttaaatataccatttcacacaaagtttgaatagaatacattatacctcataggtgtctagcctctacagttctggctgtagttatgaccttggcttccctgtctaactgtagacaaatctttaaaaaaaaataataataatctggtgcctcagtttccccacatgtgcaatgggatacttattaaataattaataagaatgtgaataagtgtcatacttttgtgatttgagccatcatttcacttctgattttaagacaactcatgattgttagctttcagaaagctaatgattgttaactttttgaaattagtttacaattaattaagatttcattatgatggaaggagacataattggcagatctttgccatctctctttgagatgtcctaaaaagggttgtaaaaatctgtgaaaaagtttttcctacatttgactagaaaatgtgatccatagtatttagtgccctgatactataagctcagcaagtaacctggtacatttgaaataaaaaccaaatttttagattcaaacaatccctttatccttaatttaattaattatcatatgctttttttaatgaagtgcttgatcacttgcaaacatatatacatgtagatgtacatatacatgtacacatacacataaatattattgcaattaagtgatcaagtacagacacaataggggccagttttgtttaaggatcaaagagacaaccactttggggaattagtatcaacttacaatccaagtccaagtatcatcttataatcacttttttctactatattaagatctaatgaatttgatttcttttttgaagttttttcttgtaacatctgagattagaagtttaagatgacttgaccccaaacctttgtttatgtaagaatttttaaacataaaagtgtttgtttctgttatgttaccataatttgatgtatatagtgtccagatccatttagaaatttaatatttattaataactgaaactgtttgtcttcctttggtatatagtctcgcatattatattatagcaggccaagataaaattttgacagctctttaagcccacatgcagcagtgggtcagataaccctgtggcagtgacacgggcaaattggcatttgaataaagccctgggaccacctcaacatgcgtagcctcttgtcttaaatgtactccccatggcagcatggaggaggcaagacctgtgggtcaattttgaactggccttactttgatttttaaaacaagagactcagggaaagtactaaaccaaaatctctgattttactttgcgttttctgtagtttttgttttactgagatgcttttgtaaaggaaaataatactgtgacagtttagtaattctacagattcttaatatttctccatcatggccttttacttcacaattttctgaagtctgaattcaattacaattttttttttaccaatttaatctcaaatgttgtttaactgctttaaattcatatacgtagagtattataaactgcagagatgaaaaatgtgttttcacgggatttatattgtgaactaaactaagcctactttttgtgacttatttgtgatgccttgttgataaatatgtgtaataagtatgtttaaa

SEQ ID NO: 291423 - DNA, 3876 bp, Homo sapiens
ttgctaagcgtcgccgagttgggagtgtcttcagccctaaggcagcatcagagatcataatcttctgctctcgtggcaagaaatttgtgcggatagagttgatacacctcacttgaagttggcctggagaaaagaggcgtcggactcctggacggggttgggaaacggtcaccagtttcggctcaaagcagcctgtttccaggagaccgccatggtcgaggcagcgtcctggtcccacggtgcggggccggacgatcatttatgggatataaataaaaggactatgaggtggtaaataaaagactaccaactagaagccatagggagtcatttgaaggagaaataggcacggctcatctgtggttgagggaaagggatcttgaaagatgattaggagaacttgggttctggggaaagtgcgggaagacattctggcagagaagcaaacgtgaggaaaggggtcaggagagtgctggtattgtgactagtgatgggagttcggtgccaacattcaaatcacacaagggaatgggtcttgtaaatcacgtctttactgaagacaatttgaaaaaattatatgtttcaaatcttggaattggacacaccaggtatgccaccacaggaaaatgtgaactagaaaattgtcagcccttcgttgttgaaacacttcatgggaagatagctgtggcacataatggcgaattggtaaatgctgctcgattaaggaaaaagcttctgcgtcatggtattggtctgtctacaagttctgatagtgaaatgattacccagttactggcgtatacccctcctcaggaacaagatgacaccccagactgggtagccaggattaaaaacttgatgaaggaagcacccacagcatactccctgcttataatgcacagagatgttatttatgcagtacgagatccttatggaaatcgtcccttatgcattggtcgtcttattccagtgtctgatataaatgacaaagagaaaaaaacatcagaaacagaaggatgggtggtgtcttcagaatcttgtagcttcttatctattggtgcaagatattaccgtgaagtcttgcctggagaaattgtggaaatatccagacacaatgtccaaactcttgatattatatcaaggtctgaaggaaacccagtggctttttgtatctttgaatatgtttattttgcaagaccagacagtatgttcgaagaccaaatggtttatacagtaagataccgttgtggccagcagctagcgattgaagcacctgtggatgcagatttggttagcactgttccagaatctgctacgcctgctgctcttgcttacgcaggaaagtgtggacttccatatgtggaggtgctgtgtaaaaaccggtatgtagggagaaccttcattcagccaaacatgaggttaagacaacttggtgttgcaaaaaaatttggagtattgtcagacaactttaaaggcaaaagaattgttcttgtagatgattcaattgtcagaggcaataccatctcacctataataaaactgctcaaagaatctggtgcaaaagaggtacacattcgagtagcttcaccaccaattaaatatccatgcttcatgggaataaacattcctacaaaagaagagctcattgccaataaaccagaatttgatcaccttgcagaatatctaggagcaaacagtgttgtgtatctgtcagtagaaggactggtttcatctgtacaagaagggataaagtttaaaaaacagaaagagaaaaagcacgatattatgatccaagaaaatggaaatggtctggaatgttttgaaaagagtggtcattgtacagcttgtctcactggaaaatatcctgtagaattagaatggtagctggtagggttggatgtgtgtagtttcaagatagaaagttggtcaagaagttatagtggtcacacctcatctatttactgttactcagttggtacaatgtaaaatgccatgcttatgtttataagttttgagatttttttttttttctgaaaaggataccaaagtgcgataactgaacatttccaattgcatataatacaacaatatgtggtgttcttttttttacacaagcattggctagcctttttaacctggtcagagaaggcaggtggtcactgacatttcccaagtccatgctttaaagggtttgcaagaagttagggttaaggagaggtgatgccaacaagacaggtgagttaaatataccatttcacacaaagtttgaatagaatacattatacctcataggtgtctagcctctacagttctggctgtagttatgaccttggcttccctgtctaactgtagacaaatctttaaaaaaaaataataataatctggtgcctcagtttccccacatgtgcaatgggatacttattaaataattaataagaatgtgaataagtgtcatacttttgtgatttgagccatcatttcacttctgattttaagacaactcatgattgttagctttcagaaagctaatgattgttaactttttgaaattagtttacaattaattaagatttcattatgatggaaggagacataattggcagatctttgccatctctctttgagatgtcctaaaaagggttgtaaaaatctgtgaaaaagtttttcctacatttgactagaaaatgtgatccatagtatttagtgccctgatactataagctcagcaagtaacctggtacatttgaaataaaaaccaaatttttagattcaaacaatccctttatccttaatttaattaattatcatatgctttttttaatgaagtgcttgatcacttgcaaacatatatacatgtagatgtacatatacatgtacacatacacataaatattattgcaattaagtgatcaagtacagacacaataggggccagttttgtttaaggatcaaagagacaaccactttggggaattagtatcaacttacaatccaagtccaagtatcatcttataatcacttttttctactatattaagatctaatgaatttgatttcttttttgaagttttttcttgtaacatctgagattagaagtttaagatgacttgaccccaaacctttgtttatgtaagaatttttaaacataaaagtgtttgtttctgttatgttaccataatttgatgtatatagtgtccagatccatttagaaatttaatatttattaataactgaaactgtttgtcttcctttggtatatagtctcgcatattatattatagcaggccaagataaaattttgacagctctttaagcccacatgcagcagtgggtcagataaccctgtggcagtgacacgggcaaattggcatttgaataaagccctgggaccacctcaacatgcgtagcctcttgtcttaaatgtactccccatggcagcatggaggaggcaagacctgtgggtcaattttgaactggccttactttgatttttaaaacaagagactcagggaaagtactaaaccaaaatctctgattttactttgcgttttctgtagtttttgttttactgagatgcttttgtaaaggaaaataatactgtgacagtttagtaattctacagattcttaatatttctccatcatggccttttacttcacaattttctgaagtctgaattcaattacaattttttttttaccaatttaatctcaaatgttgtttaactgctttaaattcatatacgtagagtattataaactgcagagatgaaaaatgtgttttcacgggatttatattgtgaactaaactaagcctactttttgtgacttatttgtgatgccttgttgataaatatgtgtaataagtatgtttaaa

SEQ ID NO: 291424 - DNA, 2315 bp, Homo sapiens
aaagaaaggctaaaggagaaatttatcctagcttaaattattctgtttgtaactattctctgttgacgcgtttcttcctttctaaaggaattcttattacatttttatttttccctctttctttaggagcaaacagtgttgtgtatctgtcagtagaaggactggtttcatctgtacaagaagggataaagtttaaaaaacagaaagagaaaaagcacgatattatgatccaagaaaatggaaatggtctggaatgttttgaaaagagtggtcattgtacagcttgtctcactggaaaatatcctgtagaattagaatggtagctggtagggttggatgtgtgtagtttcaagatagaaagttggtcaagaagttatagtggtcacacctcatctatttactgttactcagttggtacaatgtaaaatgccatgcttatgtttataagttttgagatttttttttttttctgaaaaggataccaaagtgcgataactgaacatttccaattgcatataatacaacaatatgtggtgttcttttttttacacaagcattggctagcctttttaacctggtcagagaaggcaggtggtcactgacatttcccaagtccatgctttaaagggtttgcaagaagttagggttaaggagaggtgatgccaacaagacaggtgagttaaatataccatttcacacaaagtttgaatagaatacattatacctcataggtgtctagcctctacagttctggctgtagttatgaccttggcttccctgtctaactgtagacaaatctttaaaaaaaaataataataatctggtgcctcagtttccccacatgtgcaatgggatacttattaaataattaataagaatgtgaataagtgtcatacttttgtgatttgagccatcatttcacttctgattttaagacaactcatgattgttagctttcagaaagctaatgattgttaactttttgaaattagtttacaattaattaagatttcattatgatggaaggagacataattggcagatctttgccatctctctttgagatgtcctaaaaagggttgtaaaaatctgtgaaaaagtttttcctacatttgactagaaaatgtgatccatagtatttagtgccctgatactataagctcagcaagtaacctggtacatttgaaataaaaaccaaatttttagattcaaacaatccctttatccttaatttaattaattatcatatgctttttttaatgaagtgcttgatcacttgcaaacatatatacatgtagatgtacatatacatgtacacatacacataaatattattgcaattaagtgatcaagtacagacacaataggggccagttttgtttaaggatcaaagagacaaccactttggggaattagtatcaacttacaatccaagtccaagtatcatcttataatcacttttttctactatattaagatctaatgaatttgatttcttttttgaagttttttcttgtaacatctgagattagaagtttaagatgacttgaccccaaacctttgtttatgtaagaatttttaaacataaaagtgtttgtttctgttatgttaccataatttgatgtatatagtgtccagatccatttagaaatttaatatttattaataactgaaactgtttgtcttcctttggtatatagtctcgcatattatattatagcaggccaagataaaattttgacagctctttaagcccacatgcagcagtgggtcagataaccctgtggcagtgacacgggcaaattggcatttgaataaagccctgggaccacctcaacatgcgtagcctcttgtcttaaatgtactccccatggcagcatggaggaggcaagacctgtgggtcaattttgaactggccttactttgatttttaaaacaagagactcagggaaagtactaaaccaaaatctctgattttactttgcgttttctgtagtttttgttttactgagatgcttttgtaaaggaaaataatactgtgacagtttagtaattctacagattcttaatatttctccatcatggccttttacttcacaattttctgaagtctgaattcaattacaattttttttttaccaatttaatctcaaatgttgtttaactgctttaaattcatatacgtagagtattataaactgcagagatgaaaaatgtgttttcacgggatttatattgtgaactaaactaagcctactttttgtgacttatttgtgatgccttgttgataaatatgtgtaataagtatgtttaaa

SEQ ID NO: 291425 - DNA, 2180 bp, Homo sapiens
gccgcagtagctggggccaccctcgggaaggaagagtctgtcgcgagcgcgagcttctgagctcgacgggccgagctggcagctggttggtgcttacaccttggccgcagcggcaggtccttccacgtgctttcggcggcgacatggagctggaggagttggggatccgagaggaatgtggcgtgttcgggtgcatcgcctcaggagagtggcccacgcagctggatgtaccgcatgtgatcactctgggactcgtggggctgcagcaccggggtcaggagagtgctggtattgtgactagtgatgggagttcggtgccaacattcaaatcacacaagggaatgggtcttgtaaatcacgtctttactgaagacaatttgaaaaaattatatgtttcaaatcttggaattggacacaccaggtatgccaccacaggaaaatgtgaactagaaaattgtcagcccttcgttgttgaaacacttcatgggaagatagctgtggcacataatggcgaattggtaaatgctgctcgattaaggaaaaagcttctgcgtcatggtattggtctgtctacaagttctgatagtgaaatgattacccagttactggcgtatacccctcctcaggaacaagatgacaccccagactgggtagccaggattaaaaacttgatgaaggaagcacccacagcatactccctgcttataatgcacagagatgttatttatgcagtacgagatccttatggaaatcgtcccttatgcattggtcgtcttattccagtgtctgatataaatgacaaagagaaaaaaacatcagaaacagaaggatgggtggtgtcttcagaatcttgtagcttcttatctattggtgcaagatattaccgtgaagtcttgcctggagaaattgtggaaatatccagacacaatgtccaaactcttgatattatatcaaggtctgaaggaaacccagtggctttttgtatctttgaatatgtttattttgcaagaccagacagtatgttcgaagaccaaatggtttatacagtaagataccgttgtggccagcagctagcgattgaagcacctgtggatgcagatttggttagcactgttccagaatctgctacgcctgctgctcttgcttacgcaggaaagtgtggacttccatatgtggaggtgctgtgtaaaaaccggtatgtagggagaaccttcattcagccaaacatgaggttaagacaacttggtgttgcaaaaaaatttggagtattgtcagacaactttaaaggcaaaagaattgttcttgtagatgattcaattgtcagaggcaataccatctcacctataataaaactgctcaaagaatctggtgcaaaagaggtacacattcgagtagcttcaccaccaattaaatatccatgcttcatgggaataaacattcctacaaaagaagagctcattgccaataaaccagaatttgatcaccttgcagaatatctaggagcaaacagtgttgtgtatctgtcagtagaaggactggtttcatctgtacaagaagggataaagtttaaaaaacagaaagagaaaaagcacgatattatgatccaagaaaatggaaatggtctggaatgttttgaaaagagtggtcattgtacagcttgtctcactggaaaatatcctgtagaattagaatggtagctggtagggttggatgtgtgtagtttcaagatagaaagttggtcaagaagttatagtggtcacacctcatctatttactgttactcagttggtacaatgtaaaatgccatgcttatgtttataagttttgagatttttttttttttctgaaaaggataccaaagtgcgataactgaacatttccaattgcatataatacaacaatatgtggtgttcttttttttacacaagcattggctagcctttttaacctggtcagagaaggcaggtggtcactgacatttcccaagtccatgctttaaagggtttgcaagaagttagggttaaggagaggtgatgccaacaagacaggtgagttaaatataccatttcacacaaagtttgaatagaatacattatacctcataggtgtctagcctctacagttctggctgtagttatgaccttggcttccctctcattgtagcccccccctttcccccg

SEQ ID NO: 291426 - DNA, 1804 bp, Homo sapiens
gccgcagtagctggggccaccctcgggaaggaagagtctgtcgcgagcgcgagcttctgagctcgacgggccgagctggcagctggttggtgcttacaccttggccgcagcggcaggtccttccacgtgctttcggcggcgacatggagctggaggagttggggatccgagaggaatgtggcgtgttcgggtgcatcgcctcaggagagtggcccacgcagctggatgtaccgcatgtgatcactctgggactcgtggggctgcagcaccggggtcaggagagtgctggtattgtgactagtgatgggagttcggtgccaacattcaaatcacacaagggaatgggtcttgtaaatcacgtctttactgaagacaatttgaaaaaattatatgtttcaaatcttggaattggacacaccaggtatgccaccacaggaaaatgtgaactagaaaattgtcagcccttcgttgttgaaacacttcatgggaagatagctgtggcacataatggcgaattggtaaatgctgctcgattaaggaaaaagcttctgcgtcatggtattggtctgtctacaagttctgatagtgaaatgattacccagttactggcgtatacccctcctcaggaacaagatgacaccccagactgggtagccaggattaaaaacttgatgaaggaagcacccacagcatactccctgcttataatgcacagagatgttatttatgcagtacgagatccttatggaaatcgtcccttatgcattggtcgtcttattccagtgtctgatataaatgacaaagagaaaaaaacatcagaaacagaaggatgggtggtgtcttcagaatcttgtagcttcttatctattggtgcaagatattaccgtgaagtcttgcctggagaaattgtggaaatatccagacacaatgtccaaactcttgatattatatcaaggtctgaaggaaacccagtggctttttgtatctttgaatatgtttattttgcaagaccagacagtatgttcgaagaccaaatggtttatacagtaagataccgttgtggccagcagctagcgattgaagcacctgtggatgcagatttggttagcactgttccagaatctgctacgcctgctgctcttgcttacgcaggaaagtgtggacttccatatgtggaggtgctgtgtaaaaaccggtatgtagggagaaccttcattcagccaaacatgaggttaagacaacttggtgttgcaaaaaaatttggagtattgtcagacaactttaaaggcaaaagaattgttcttgtagatgattcaattgtcagaggcaataccatctcacctataataaaactgctcaaagaatctggtgcaaaagaggtaagtaatattaaaacatatcctaaagcataagttaacaataagatactggcataaaattgcaattcagggtagtgaatcaaaatggatgttcaatataataaattaactttttttatcagtttggtttaggaataactgtgtagcaacttgaagaacatgtcacagccacacttacattaaatgtaatccttaatagattaaaaaagctcaatataaaagcttaaggctgggcgaggtagctcatgcctgtaatcccagtactttgggagcctgaggtaggaggttgcttgagcccaggagttcgagaacagcctgggcaatatagtgagaccctgtctctacaaaaataaaagataataataaaattaaattttaaaaaacctaaaatttttacaaaatttattcaaagactaactacacaa

SEQ ID NO: 291427 - DNA, 621 bp, Homo sapiens
  misc_feature (497)..(497): n is a, c, g, or t
  misc_feature (500)..(500): n is a, c, g, or t
  misc_feature (595)..(595): n is a, c, g, or t
gccgcagtagctggggccaccctcgggaaggaagagtctgtcgcgagcgcgagcttctgagctcgacgggccgagctggcagctggttggtgcttacaccttggccgcagcggcaggtccttccacgtgctttcggcggcgacatggagctggaggagttggggatccgagaggaatgtggcgtgttcgggtgcatcgcctcaggagagtggcccacgcagctggatgtaccgcatgtgatcactctgggactcgtggggctgcagcaccggggtcaggagagtgctggtattgtgactagtgatgggagttcggtgccaacattcaaatcacacaagggaatgggtcttgtaaatcacgtctttactgaagacaatttgaaaaaattatatgtttcaaatcttggaattggacacaccaggtatgccaccacaggaaaatgtgaactagaaaattgtcagcccttcgttgttgaaacacttcatgggaagataccncgntccaaattatccataaggccgaatgcatcagtcaggttcctaaaacaggagcactaagtcttggcctagcgagaaaacggtgtagactcattgtnggaaatacggatgccacgagaaaaag

SEQ ID NO: 291428 - DNA, 405 bp, Homo sapiens
gtgtaacgagggtcacacaactctgaatatatactaaaaaaaagtgaggccgggcacagtggctcatgcctgtaatgccagcacttggggaggctgaggtgggtggatcacctgaggtcaggagttcaagaccatcttggccaacatgatgaaaccccgtttctactaaaaatacaaaaaattagccaggcattgtggtgcgcacctatagtcccagttccttgggaggctgaggtgggagaattgcttgagtccaggagacggaggttacagtgagctgtgatcacaccgctgcactccagcctgggcgacagcgagaccccatttcagaaagaatttaaaagggcagtgatgtgcagggtggtgggaggacatcccccagaagagggggcagacacagtacca

SEQ ID NO: 291429 - DNA, 4300 bp, Homo sapiens
cgttagttctccgggtacctcaggcgcctcagcctccttagtctcctcatcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgccctccgcaccactagcctctcgggagcatggcgtcggccccgccggcctcgcccccgggctcggagccgccggggcccgacccggagccgggcgggccggacgggccgggggcggcgcaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtgaaggacttaactaagtacttggatcccagtgggctcggcgtgatcagctttgaagacttctaccaagggatcacagccatcagaaacggagatcctgatggccagtgctacggtggtgtcgcttctgcccaagatgaggagcccctggcctgcccggacgagttcgatgacttcgtcacctatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcaggagaacctgcagctggtgcacagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggctacagcaactggacgaggagaacagtgaactccggtcctgcacgccctgtctgaaggccaacattgagcgtctggaggaggagaagcagaagctgttggatgagatagagtcgctgacgctgcggctcagtgaagagcaggagaacaagaggagaatgggggacaggctgagtcacgagaggcaccagttccagagggacaaggaggccacccaggagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggacaaccgcaacctgaaggagcagaacgaggagctgaacgggcagatcattaccctcagcatccagggcgccaagagcctcttctccacagccttctctgagtccctggctgcagagatcagctccgtctcccgagatgagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatatatatatgtataatatataaagactggcaccctgcctctctgtgcccaggcccagccctggtgacatggcaccactcagcagtgctgtcactgtaagcatggactcccaggagacagtgtgggaaacgctcctgctttaattccccgagaaacggctcttcctgcctggatgcaggagggcaggggccaccacagattaaagctgttactgcaca

SEQ ID NO: 291430 - DNA, 4435 bp, Homo sapiens
cgttagttctccgggtacctcaggcgcctcagcctccttagtctcctcatcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgccctccgcaccactagcctctcgggagcatggcgtcggccccgccggcctcgcccccgggctcggagccgccggggcccgacccggagccgggcgggccggacgggccgggggcggcgcaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtgaaggacttaactaagtacttggatcccagtgggctcggcgtgatcagctttgaagacttctaccaagggatcacagccatcagaaacggagatcctgatggccagtgctacggtggtgtcgcttctgcccaagatgaggagcccctggcctgcccggacgagttcgatgacttcgtcacctatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagcactgaccctcttgccgcaaagctgcacagcatcctcactgatgaggcgtttgagttttactgtagccagtgccacaaacaaatcaaccgccttgaggatctttctgcccgcctgagtgatcttgaaatgaatagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcaggagaacctgcagctggtgcacagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggctacagcaactggacgaggagaacagtgaactccggtcctgcacgccctgtctgaaggccaacattgagcgtctggaggaggagaagcagaagctgttggatgagatagagtcgctgacgctgcggctcagtgaagagcaggagaacaagaggagaatgggggacaggctgagtcacgagaggcaccagttccagagggacaaggaggccacccaggagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggacaaccgcaacctgaaggagcagaacgaggagctgaacgggcagatcattaccctcagcatccagggcgccaagagcctcttctccacagccttctctgagtccctggctgcagagatcagctccgtctcccgagatgagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatatatatatgtataatatataaagactggcaccctgcctctctgtgcccaggcccagccctggtgacatggcaccactcagcagtgctgtcactgtaagcatggactcccaggagacagtgtgggaaacgctcctgctttaattccccgagaaacggctcttcctgcctggatgcaggagggcaggggccaccacagattaaagctgttactgcaca

SEQ ID NO: 291431 - DNA, 2514 bp, Homo sapiens
aggcaggttctctggaggtcctgaggcagcttctgggcatgggtggagccactgcacaccctgcctggagacagctcagctcctccctttgcctttcaagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggctacagcaactggacgaggagaacagtgaactccggtcctgcacgccctgtctgaaggccaacattgagcgtctggaggaggagaagcagaagctgttggatgagatagagtcgctgacgctgcggctcagtgaagagcaggagaacaagaggagaatgggggacaggctgagtcacgagaggcaccagttccagagggacaaggaggccacccaggagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggacaaccgcaacctgaaggagcagaacgaggagctgaacgggcagatcattaccctcagcatccagggcgccaagagcctcttctccacagccttctctgagtccctggctgcagagatcagctccgtctcccgagatgagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatatatatatgtataatatataaagactggcaccctgcctctctgtgcccaggcccagccctggtgacatggcaccactcagcagtgctgtcactgtaagcatggactcccaggagacagtgtgggaaacgctcctgctttaattccccgagaaacggctcttcctgcctggatgcaggagggcaggggccaccacagattaaagctgttactgcaca

SEQ ID NO: 291432 - DNA, 4990 bp, Homo sapiens
cgttagttctccgggtacctcaggcgcctcagcctccttagtctcctcatcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgccctccgcaccactagcctctcgggagcatggcgtcggccccgccggcctcgcccccgggctcggagccgccggggcccgacccggagccgggcgggccggacgggccgggggcggcgcaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtgaaggacttaactaagtacttggatcccagtgggctcggcgtgatcagctttgaagacttctaccaagggatcacagccatcagaaacggagatcctgatggccagtgctacggtggtgtcgcttctgcccaagatgaggagcccctggcctgcccggacgagttcgatgacttcgtcacctatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagcactgaccctcttgccgcaaagctgcacagcatcctcactgatgaggcgtttgagttttactgtagccagtgccacaaacaaatcaaccgccttgaggatctttctgcccgcctgagtgatcttgaaatgaatagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcaggagaacctgcagctggtgcacagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggctacagcaactggacgaggagaacagtgaactccggtcctgcacgccctgtctgaaggccaacattgagcgtctggaggaggagaagcagaagctgttggatgagatagagtcgctgacgctgcggctcagtgaagagcaggagaacaagaggagaatgggggacaggctgagtcacgagaggcaccagttccagagggacaaggaggccacccaggagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggacaaccgcaacctgaaggagcagaacgaggagctgaacgggcagatcattaccctcagcatccagggcgccaagagcctcttctccacagccttctctgagtccctggctgcagagatcagctccgtctcccgagatgagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtgtgtgcgcgcatgtgtgcgtgcgtgcacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatatatatatgtataatatataaagactggcaccctgcctctctgtgcccaggcccagccctggtgacatggcaccactcagcagtgctgtcactgtaagcatggactcccaggagacagtgtgggaaacgctcctgctttaattccccgagaaacggctcttcctgcctggatgcaggagggcaggggccaccacagattaaagctgttactgcacacgcagaggccggcttcttcctccaggggggccacagggtggggtgggagtcttctgggcctggcccagcttccctcaaggcgtccgaggccatcagttgtctgagctcagaacccagcagacctgcctggctctgcagcttggtcagactaagacccttccaaggccgtaggattgcacctccaggcccagtggagcctggcagctttccagccaggttctggatcctgacgagctgctgagacagcatcaaggtggggcaggtggggcggggcaaattgggcagcacagggctgtgtgggcatcagggctctgggtcacacgcctctggggacgtacgtcccatgtcgggagagccgtcaaaacgtccccgggattaagagaagagtggggggcagggcgcagaggctcacgccataatctcagcactttgggaggccaaggcaggaggatcgcttgaacccgggagttcaagaccagcctgggcaacatagcaaggccccatctctaaaaaataaaaaattaaccag

SEQ ID NO: 291433 - DNA, 2907 bp, Homo sapiens
cgttagttctccgggtacctcaggcgcctcagcctccttagtctcctcatcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgccctccgcaccactagcctctcgggagcatggcgtcggccccgccggcctcgcccccgggctcggagccgccggggcccgacccggagccgggcgggccggacgggccgggggcggcgcaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtgaaggacttaactaagtacttggatcccagtgggctcggcgtgatcagctttgaagacttctaccaagggatcacagccatcagaaacggagatcctgatggccagtgctacggtggtgtcgcttctgcccaagatgaggagcccctggcctgcccggacgagttcgatgacttcgtcacctatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagcactgaccctcttgccgcaaagctgcacagcatcctcactgatgaggcgtttgagttttactgtagccagtgccacaaacaaatcaaccgccttgaggatctttctgcccgcctgagtgatcttgaaatgaatagtccgacaaagcggctctccagcaagaaggtggcaaggtaggtgggtctctggttcctgctgaaaaacgttctgaagtggataattaatcatagttttttaaaaaacattttaaaatgttcttttccaaggtattttttaaactcttgcaagttactttacatggtttggggctgaaggtatcctgaaggagtgttgggaaaggggtttccagggctgtgaatttggacctggatttgtgaccagggagggtacgtgtcagagcttttggtgctgggcctcttgtgtgttcactaaggtctggaaggggccgccatccccagatgtctgctctatgttagctctgaggtagcgagacccagtgaggagcctggcttctcagagccgggtctgggcagctccccaaggtgagtcgaaggtgagggatgggtctgactccaattcctaaagaccatttcttcattttccagcttcgtatagatctgttggcttcctgctgtgaaagatggcaacatacacttttatcttcctcccctgccagttcttaccgaaataaacatgcagggttaaggcccttcccagggagccactcagtgtggctgccgggtggcctctgctgccgtcagagtctgcctttgtgtctttatctgctttgccttcctagtccccgtcctgcttcgtggcccggcatctggcagggctgggagacgcctctccagcttcctctggagcatcccctctggagcctcctctctgccctgttgtgccgggcgttctccaggcctcgtggctgtggtcctggacaggtctccccacactggtgggttcctttgtttcgggggttggatcctctagctccctggccccgtcttccttctcatttgttttctctggtttttgtccagcgtatcttcctgtagcttcttgagaaaagaggtgctcaggagataaacttgagcttgggttggtttgtactgtgagagtgggatcattttcctgtaagatttttgacggcattgcttatcttctagagctaaagttgttaccatgaagtttaacctttctgactcggtttctttgggaccagcctgagcaacttagtgaaaccctgtctctacaaaa

SEQ ID NO: 291434 - DNA, 2475 bp, Homo sapiens
cgttagttctccgggtacctcaggcgcctcagcctccttagtctcctcatcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgccctccgcaccactagcctctcgggagcatggcgtcggccccgccggcctcgcccccgggctcggagccgccggggcccgacccggagccgggcgggccggacgggccgggggcggcgcaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtgaaggacttaactaagtacttggatcccagtgggctcggcgtgatcagctttgaagacttctaccaagggatcacagccatcagaaacggagatcctgatggccagtgctacggtggtgtcgcttctgcccaagatgaggagcccctggcctgcccggacgagttcgatgacttcgtcacctatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagcactgaccctcttgccgcaaagctgcacagcatcctcactgatgaggcgtttgagttttactgtagccagtgccacaaacaaatcaaccgccttgaggatctttctgcccgcctgagtgatcttgaaatgaatagtccgacaaagcggctctccagcaagaaggtggcaagcttcgtatagatctgttggcttcctgctgtgaaagatggcaacatacacttttatcttcctcccctgccagttcttaccgaaataaacatgcagggttaaggcccttcccagggagccactcagtgtggctgccgggtggcctctgctgccgtcagagtctgcctttgtgtctttatctgctttgccttcctagtccccgtcctgcttcgtggcccggcatctggcagggctgggagacgcctctccagcttcctctggagcatcccctctggagcctcctctctgccctgttgtgccgggcgttctccaggcctcgtggctgtggtcctggacaggtctccccacactggtgggttcctttgtttcgggggttggatcctctagctccctggccccgtcttccttctcatttgttttctctggtttttgtccagcgtatcttcctgtagcttcttgagaaaagaggtgctcaggagataaacttgagcttgggttggtttgtactgtgagagtgggatcattttcctgtaagatttttgacggcattgcttatcttctagagctaaagttgttaccatgaagtttaacctttctgactcggtttctttgggaccagcctgagcaacttagtgaaaccctgtctctacaaaa

SEQ ID NO: 291435 - DNA, 2340 bp, Homo sapiens
cgttagttctccgggtacctcaggcgcctcagcctccttagtctcctcatcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgccctccgcaccactagcctctcgggagcatggcgtcggccccgccggcctcgcccccgggctcggagccgccggggcccgacccggagccgggcgggccggacgggccgggggcggcgcaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtgaaggacttaactaagtacttggatcccagtgggctcggcgtgatcagctttgaagacttctaccaagggatcacagccatcagaaacggagatcctgatggccagtgctacggtggtgtcgcttctgcccaagatgaggagcccctggcctgcccggacgagttcgatgacttcgtcacctatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagtccgacaaagcggctctccagcaagaaggtggcaagcttcgtatagatctgttggcttcctgctgtgaaagatggcaacatacacttttatcttcctcccctgccagttcttaccgaaataaacatgcagggttaaggcccttcccagggagccactcagtgtggctgccgggtggcctctgctgccgtcagagtctgcctttgtgtctttatctgctttgccttcctagtccccgtcctgcttcgtggcccggcatctggcagggctgggagacgcctctccagcttcctctggagcatcccctctggagcctcctctctgccctgttgtgccgggcgttctccaggcctcgtggctgtggtcctggacaggtctccccacactggtgggttcctttgtttcgggggttggatcctctagctccctggccccgtcttccttctcatttgttttctctggtttttgtccagcgtatcttcctgtagcttcttgagaaaagaggtgctcaggagataaacttgagcttgggttggtttgtactgtgagagtgggatcattttcctgtaagatttttgacggcattgcttatcttctagagctaaagttgttaccatgaagtttaacctttctgactcggtttctttgggaccagcctgagcaacttagtgaaaccctgtctctacaaaa

SEQ ID NO: 291436 - DNA, 2163 bp, Homo sapiens
cgttagttctccgggtacctcaggcgcctcagcctccttagtctcctcatcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgccctccgcaccactagcctctcgggagcatggcgtcggccccgccggcctcgcccccgggctcggagccgccggggcccgacccggagccgggcgggccggacgggccgggggcggcgcaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtgaaggacttaactaagtacttggatcccagtgggctcggcgtgatcagctttgaagacttctaccaagggatcacagccatcagaaacggagatcctgatggccagtgctacggtggtgtcgcttctgcccaagatgaggagcccctggcctgcccggacgagttcgatgacttcgtcacctatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagcactgaccctcttgccgcaaagctgcacagcatcctcactgatgaggcgtttgagttttactgtagccagtgccacaaacaaatcaaccgccttgaggatctttctgcccgcctgagtgatcttgaaatgaatagtccgacaaagcggctctccagcaagaaggtggcaagcttcgtatagatctgttggcttcctgctgtgaaagatggcaacatacacttttatcttcctcccctgccagttcttaccgaaataaacatgcagggttaaggcccttcccagggagccactcagtgtggctgccgggtggcctctgctgccgtcagaaacaaaaacaacacggagacaagagaacgaagaacgcgcaagaagtgaaagaaacgggcgcagtttgtgggggcggggacagagtggtagtagaaggcacatgcgatcgagtggcagagcccgttgttgaaggaggggggacaggggggcccctagagggggaatatagagacgaggcccgag

SEQ ID NO: 291437 - DNA, 2202 bp, Homo sapiens
cgttagttctccgggtacctcaggcgcctcagcctccttagtctcctcatcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgccctccgcaccactagcctctcgggagcatggcgtcggccccgccggcctcgcccccgggctcggagccgccggggcccgacccggagccgggcgggccggacgggccgggggcggcgcaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtgaaggacttaactaagtacttggatcccagtgggctcggcgtgatcagctttgaagacttctaccaagggatcacagccatcagaaacggagatcctgatggccagtgctacggtggtgtcgcttctgcccaagatgaggagcccctggcctgcccggacgagttcgatgacttcgtcacctatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagcactgaccctcttgccgcaaagctgcacagcatcctcactgatgaggcgtttgagttttactgtagccagtgccacaaacaaatcaaccgccttgaggatctttctgcccgcctgagtgatcttgaaatgaatagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcaggagaacctgcagctggtgcacagcagagacgccctgcaggagcagatgaacaggacgcagagagcaggaggaagacctgcgaagaatgcgatccaagagacagacgaacgcagagcgatgagaaagagaagcgtcactgtgcaacgactggagacgggagaacaagcactaagagaatagagaaacgactaaaagaatcagaaa

SEQ ID NO: 291438 - DNA, 465 bp, Homo sapiens
aaacgtggctcccaggactcacgtgtggcttgtagcacaccctatggaaagcaccttccacaccctcagctcgggggtgccctggccttcagtcagaagacatcatttctgttttactttgcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccaggtaatgacgccttgttccagcacaccctcctccctcttcttcccgtggttagtagtgggaagtttccctttttggttcgtgcattggtgagagaacttgctttccttgacgtcatgtgattaagtaaaccatattcaaacattttaaatttatacctggatttatgaaagttgggagaagtccctcttctc

SEQ ID NO: 291439 - DNA, 787 bp, Homo sapiens
ccccgcctccgagccgtgttcgatgccctggacggggatggggacggtttcgtccgcatcgaggacttcatccagtttgctacggtctacggggcagagcaggtacggagcggcccgggccggggcgtgggaactgggcaggtgcgcgctggccggcggggttgatgtgggaccggtcgacgctgcccctggagtcgggaaaggcactgtcaagacctgacggtcctgctttttctgcttattcaccacttcggccctggatttctggttgaattgcgctggagtccctcttcccttcttaaaaggaggttctattctggggagtcagtttcttcccctccccccagcgcctcgtcagctggatcttaccgaggtcagctcctcgcctggggacacccccccagggggcctgatcgccacccccccagggtgcctgatcgacgtgcccctgaatgaagaagttccccgcgattcccccacccgagggcccagatactgctcggctgaattcacccaagttctagccgcagaggccaggctgcccagacgccttgagatcctactgatagacacctattttgagtacaattactttactgtgtgtggttgacatcttttctacttagatttcatcttttatttgggagacagtcaatgcttgtagagagtcctggaattaagaatttttactttggtgcctttggggaggaaggcaatgagcctcggagcttgttggcaaatgcagaagtctagcagaactccgttagggccacgtccactctcgtag

SEQ ID NO: 291440 - DNA, 314 bp, Homo sapiens
ggcgtctgttggtcacagggcggccccagcagggtttccctgagacacagggcacactggccctgtagaggcgagcttcctggagtgagtttcagctttgttcttgtgtcccaggctacagcaactggacgaggagaacagtgaactccggtcctgcacgccctgtctgaaggccaacattgagcgtctggaggaggtgagctgccaacagcctggagctgtggccagtggggccagcccatgccctgcctgtggggcagctgaggtagccctgagctctgtgctgagcgggatactgtgctgtgtgtgaggga

SEQ ID NO: 291441 - DNA, 467 bp, Homo sapiens
gtgaaggacttaactaagtacttggatcccagtgggctcggcgtgatcagctttgaagacttctaccaagggatcacagccatcagaaacggaggtcagtcatccccgccatgagctcccacctcctctcccgttcctcagccaccctctcagccacctgcacatcaccaggctcctcgtgctgactctaacatctttccttctccttgaagcccccaacataccccaggtttccaggtggtctctttcctttcttgttaccttctcctcacataccctgttttccagaatttgctgcgttaactacttttccataatgctagaaagcaactgcccccttcctcaaagatttcatgatgacaatttgagaattttcaaaatattgaaagaatgattccatggccacccaagtgggtgttcatcacccgtgctctgcaggcagcacttcgtcgcactctctccccacg

SEQ ID NO: 291442 - DNA, 4829 bp, Homo sapiens
cgttagttctccgggtacctcaggcgcctcagcctccttagtctcctcatcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgccctccgcaccactagcctctcgggagcatggcgtcggccccgccggcctcgcccccgggctcggagccgccggggcccgacccggagccgggcgggccggacgggccgggggcggcgcaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtgaaggacttaactaagtacttggatcccagtgggctcggcgtgatcagctttgaagacttctaccaagggatcacagccatcagaaacggagatcctgatggccagtgctacggtggtgtcgcttctgcccaagatgaggagcccctggcctgcccggacgagttcgatgacttcgtcacctatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcaggagaacctgcagctggtgcacagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggctacagcaactggacgaggagaacagtgaactccggtcctgcacgccctgtctgaaggccaacattgagcgtctggaggaggagaagcagaagctgttggatgagatagagtcgctgacgctgcggctcagtgaagagcaggagaacaagaggagaatgggggacaggctgagtcacgagaggcaccagttccagagggacaaggaggccacccaggagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggacaaccgcaacctgaaggagcagaacgaggagctgaacgggcagatcattaccctcagcatccagggcgccaagagcctcttctccacagccttctctgagtccctggctgcagagatcagctccgtctcccgagatgagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatatatatatgtataatatataaagactggcaccctgcctctctgtgcccaggcccagccctggtgacatggcaccactcagcagtgctgtcactgtaagcatggactcccaggagacagtgtgggaaacgctcctgctttaattccccgagaaacggctcttcctgcctggatgcaggagggcaggggccaccacagattaaagctgttactgcacacgcagaggccggcttcttcctccaggggggccacagggtggggtgggagtcttctgggcctggcccagcttccctcaaggcgtccgaggccatcagttgtctgagctcagaacccagcagacctgcctggctctgcagcttggtcagactaagacccttccaaggccgtaggattgcacctccaggcccagtggagcctggcagctttccagccaggttctggatcctgacgagctgctgagacagcatcaaggtggggcaggtggggcggggcaaattgggcagcacagggctgtgtgggcatcagggctctgggtcacacgcctctggggacgtacgtcccatgtcgggagagccgtcaaaacgtccccgggattaagagaagagtggggggcagggcgcagaggctcacgccataatctcagcactttgggaggccaaggcaggaggatcgcttgaacccgggagttcaagaccagcctgggcaacatagcaaggccccatctctaaaaaataaaaaattaaccag

SEQ ID NO: 291443 - DNA, 562 bp, Homo sapiens
agaaggtgggctgcggactttcagacgtggcccttaacctccccgaactgacctaggctagtcagtcagccggcggtctgaccttctccatctgtgactgagtcacagtcacagggcttccctagaccccggttccagtagctggctcggtgctcttctcggccacctgccatggcccgggggctgcccaccattgctagcctggcacgcttatgccagaagctgaaccgcctgaagccgctggaggactccaccatggagacgtcactgcggcgctgcctgtccacactggacctgactcttctgggcgtgggtggcatggtgggctcgggtctctacgtgctcacaggtgccgtggccaaggaggtggctggccctgctgtgctcttgtccttcggtgtggccgctgtggcctccctgctggcagccctatgctatgcagaatttggggcacgtgtgccacgcacgggctctgcctacctgttcacctacgtatccacagcccaagggatccataataataattgcttggccagccatgtggcctgctggcgtaaaaaaa

SEQ ID NO: 291444 - DNA, 2330 bp, Homo sapiens
actcaattggcacgagggcagcggctgcggcagcagcaggttccagtagctggctcggtgctcttctcggccacctgccatggcccgggggctgcccaccattgctagcctggcacgcttatgccagaagctgaaccgcctgaagccgctggaggactccaccatggagacgtcactgcggcgctgcctgtccacactggacctgactcttctgggcgtgggtggcatggtgggctcgggtctctacgtgctcacaggtgccgtggccaaggaggtggctggccctgctgtgctcttgtccttcggtgtggccgctgtggcctccctgctggcagccctatgctatgcagaatttggggcacgtgtgccacgcacgggctctgcctacctgttcacctacgtatccatgggcgagctgtgggccttcctcatcggctggaatgttctcctcgaatacatcatcggtggcgccgccgtggcccgtgcctggagtggctacctggactctatgttcagccacagcatccgcaacttcactgagacccacgtgggttcttggcaggtgcccctcctgggccactacccggacttcctggctgctggcatcatcctcctggcctctgcctttgtctcctgtggagcccgcgtgtcctcctggctcaatcacaccttctcggccatcagcctgcttgtcattctcttcattgtcatcctgggcttcatcctggcccagcctcacaactggagcgctgacgaaggcggctttgcacccttcggcttctccggcgtcatggccggcactgcctcctgcttctatgctttcgtgggcttcgacgtcattgccgcctccagtgaggaggcccagaacccacggcggtctgtgcctctggccatcgccatctcgcttgccattgcagctggtgcctacatccttgtctccaccgtgctaaccctcatggtgccctggcacagcctggaccccgactcagcgcttgcagatgccttctaccagcggggctacaggtgggctggcttcatcgtggcagctggctccatctgcgccatgaacaccgtcctgctcagcctcctcttctccctgccacgcattgtctatgccatggccgccgatgggctcttcttccaggtgtttgcccatgtgcacccccggacacaggtgcctgtggcgggcaccctggcgttcgggctcctcacggccttcctggcactgctgctggacctggagtcgctggttcagttcctgtcccttggcacactcctggcctacacattcgtggccaccagtatcattgtgctgcgcttccagaagtcttccccgcccagctccccaggcccagccagccctggccccctgaccaagcagcagagctccttctcagaccacctacagctggtgggcactgtacacgcctccgtccctgagccaggggagctgaagccagccctgaggccctacctgggcttcttggatgggtacagccctggagcagtggtgacttgggcgcttggcgttatgttggcctcagccatcaccataggctgcgtgcttgtctttgggaactcgaccctgcacctcccacactggggttacatcctgctgctcctgctcaccagtgtcatgtttctgctcagcctccttgtcctgggggctcaccagcaacagtatcgggaagacttatttcagatccccatggttcccctgattccagccctgagcatcgtcctcaacatctgcctcatgctgaaacttagctatctgacctgggtgcgcttctccatctggctgctgatgggacttgcagtgtatttcggctatggcatccggcatagcaaggagaaccagcgggagctgccagggctgaactccacacactacgtggtattccccaggggcagcctggaggagacagtgcaggctatgcagccccccagccaggcaccagcacaggaccctggccatatggagtagctgatcagcccacacttgccccgccctcccacacctgcttgggaggccagagaggccagacaagccgagagccccttctgttgtgggcagcctgggtttgcaggcctgcacaggctggggagtcctcaggaccttaggaccttcatccaggggctgggcttcgggtcttcaggagtgggccttggctggtgctggtgccatggactctgcccagagccttcttgtttatgatcagctccagctacctgggcagttgtggtggggtggatgggaaggcccacagcccaagggatccataataataattgcttggccagccatgtggcctgctggcgtaaaaaaa

SEQ ID NO: 291445 - DNA, 467 bp, Homo sapiens
aagaattcggcacgagggcggctgcggcagcagcaggttccagtagctggctcggtgctcttctcggccacctgccatggcccgggggctgcccaccattgctagcctggcacgcttatgccagaagctgaaccgcctgaagccgctggaggactccaccatggagacgtcactgcggcgctgcctgtccacactggacctgactcttctgggcgtgggtggcatggtgggctcgggtctctacgtgctcacaggtgccgtggccaaggaggtggctggccctgctgtgctcttgtccttcggtgtggccgctgtggcctccctgctggcagccctatgctatgcagaatttggggcacgtgtgccacgcacgggctctgcctacctgttcacctacgtatccacagcccaagggatccataataataattgcttggccagccatgtggcctgctggcgtaaaaaaa

SEQ ID NO: 291446 - DNA, 2156 bp, Homo sapiens
aagaattcggcacgagggcggctgcggcagcagcaggttccagtagctggctcggtgctcttctcggccacctgccatggcccgggggctgcccaccattgctagcctggcacgcttatgccagaagctgaaccgcctgaagccgctggaggactccaccatggagacgtcactgcggcgctgcctgtccacactggacctgactcttctgggcgtgggtggcatggtgggctcgggtctctacgtgctcacaggtgccgtggccaaggaggtggctggccctgctgtgctcttgtccttcggtgtggccgctgtggcctccctgctggactctatgttcagccacagcatccgcaacttcactgagacccacgtgggttcttggcaggtgcccctcctgggccactacccggacttcctggctgctggcatcatcctcctggcctctgcctttgtctcctgtggagcccgcgtgtcctcctggctcaatcacaccttctcggccatcagcctgcttgtcattctcttcattgtcatcctgggcttcatcctggcccagcctcacaactggagcgctgacgaaggcggctttgcacccttcggcttctccggcgtcatggccggcactgcctcctgcttctatgctttcgtgggcttcgacgtcattgccgcctccagtgaggaggcccagaacccacggcggtctgtgcctctggccatcgccatctcgcttgccattgcagctggtgcctacatccttgtctccaccgtgctaaccctcatggtgccctggcacagcctggaccccgactcagcgcttgcagatgccttctaccagcggggctacaggtgggctggcttcatcgtggcagctggctccatctgcgccatgaacaccgtcctgctcagcctcctcttctccctgccacgcattgtctatgccatggccgccgatgggctcttcttccaggtgtttgcccatgtgcacccccggacacaggtgcctgtggcgggcaccctggcgttcgggctcctcacggccttcctggcactgctgctggacctggagtcgctggttcagttcctgtcccttggcacactcctggcctacacattcgtggccaccagtatcattgtgctgcgcttccagaagtcttccccgcccagctccccaggcccagccagccctggccccctgaccaagcagcagagctccttctcagaccacctacagctggtgggcactgtacacgcctccgtccctgagccaggggagctgaagccagccctgaggccctacctgggcttcttggatgggtacagccctggagcagtggtgacttgggcgcttggcgttatgttggcctcagccatcaccataggctgcgtgcttgtctttgggaactcgaccctgcacctcccacactggggttacatcctgctgctcctgctcaccagtgtcatgtttctgctcagcctccttgtcctgggggctcaccagcaacagtatcgggaagacttatttcagatccccatggttcccctgattccagccctgagcatcgtcctcaacatctgcctcatgctgaaacttagctatctgacctgggtgcgcttctccatctggctgctgatgggacttgcagtgtatttcggctatggcatccggcatagcaaggagaaccagcgggagctgccagggctgaactccacacactacgtggtattccccaggggcagcctggaggagacagtgcaggctatgcagccccccagccaggcaccagcacaggaccctggccatatggagtagctgatcagcccacacttgccccgccctcccacacctgcttgggaggccagagaggccagacaagccgagagccccttctgttgtgggcagcctgggtttgcaggcctgcacaggctggggagtcctcaggaccttaggaccttcatccaggggctgggcttcgggtcttcaggagtgggccttggctggtgctggtgccatggactctgcccagagccttcttgtttatgatcagctccagctacctgggcagttgtggtggggtggatgggaaggcccacagcccaagggatccataataataattgcttggccagccatgtggcctgctggcgtaaaaaaa

SEQ ID NO: 291447 - DNA, 2443 bp, Homo sapiens
  misc_feature (365)..(365): n is a, c, g, or t
tctcataagagcgtaatgcgcatgcagggtggccgcaagcattaacgcgttccacatacttggttcgtagctaacatctgcgtcgcgtactcctgacattgggactcggtgagctaccgcaccagttggtagcctgagcacgcttatgacatgaagctgacatgcgactgtaagcagtctgtgagtgactcgaatcattggcattactgttgactggtgagcagtatagtcgtgatccaccgcatgcgaacatgacatctttcataggcgtcgttgagggtgagcaatagtgaggagtcttctgcgatcttcttatcagatgcttctatcaagacgtacgctgttgcgactcaatagggtatggntggcttggaccacgtgcttgtgtcttacttgatccatgcagtttgtgaccagcttgttagtcctcccgtgcgtgtactggcagccctatgctatgcagaatttggggcacgtgtgccacgcacgggctctgcctacctgttcacctacgtatccatgggcgagctgtgggccttcctcatcggctggaatgttctcctcgaatacatcatcggtggcgccgccgtggcccgtgcctggagtggctacctggactctatgttcagccacagcatccgcaacttcactgagacccacgtgggttcttggcaggtgcccctcctgggccactacccggacttcctggctgctggcatcatcctcctggcctctgcctttgtctcctgtggagcccgcgtgtcctcctggctcaatcacaccttctcggccatcagcctgcttgtcattctcttcattgtcatcctgggcttcatcctggcccagcctcacaactggagcgctgacgaaggcggctttgcacccttcggcttctccggcgtcatggccggcactgcctcctgcttctatgctttcgtgggcttcgacgtcattgccgcctccagtgaggaggcccagaacccacggcggtctgtgcctctggccatcgccatctcgcttgccattgcagctggtgcctacatccttgtctccaccgtgctaaccctcatggtgccctggcacagcctggaccccgactcagcgcttgcagatgccttctaccagcggggctacaggtgggctggcttcatcgtggcagctggctccatctgcgccatgaacaccgtcctgctcagcctcctcttctccctgccacgcattgtctatgccatggccgccgatgggctcttcttccaggtgtttgcccatgtgcacccccggacacaggtgcctgtggcgggcaccctggcgttcgggctcctcacggccttcctggcactgctgctggacctggagtcgctggttcagttcctgtcccttggcacactcctggcctacacattcgtggccaccagtatcattgtgctgcgcttccagaagtcttccccgcccagctccccaggcccagccagccctggccccctgaccaagcagcagagctccttctcagaccacctacagctggtgggcactgtacacgcctccgtccctgagccaggggagctgaagccagccctgaggccctacctgggcttcttggatgggtacagccctggagcagtggtgacttgggcgcttggcgttatgttggcctcagccatcaccataggctgcgtgcttgtctttgggaactcgaccctgcacctcccacactggggttacatcctgctgctcctgctcaccagtgtcatgtttctgctcagcctccttgtcctgggggctcaccagcaacagtatcgggaagacttatttcagatccccatggttcccctgattccagccctgagcatcgtcctcaacatctgcctcatgctgaaacttagctatctgacctgggtgcgcttctccatctggctgctgatgggacttgcagtgtatttcggctatggcatccggcatagcaaggagaaccagcgggagctgccagggctgaactccacacactacgtggtattccccaggggcagcctggaggagacagtgcaggctatgcagccccccagccaggcaccagcacaggaccctggccatatggagtagctgatcagcccacacttgccccgccctcccacacctgcttgggaggccagagaggccagacaagccgagagccccttctgttgtgggcagcctgggtttgcaggcctgcacaggctggggagtcctcaggaccttaggaccttcatccaggggctgggcttcgggtcttcaggagtgggccttggctggtgctggtgccatggactctgcccagagccttcttgtttatgatcagctccagctacctgggcagttgtggtggggtggatgggaaggcccacagcccaagggatccataataataattgcttggccagccatgtggcctgctggcgtaaaaaaa

SEQ ID NO: 291448 - DNA, 2422 bp, Homo sapiens
agaaggtgggctgcggactttcagacgtggcccttaacctccccgaactgacctaggctagtcagtcagccggcggtctgaccttctccatctgtgactgagtcacagtcacagggcttccctagaccccggttccagtagctggctcggtgctcttctcggccacctgccatggcccgggggctgcccaccattgctagcctggcacgcttatgccagaagctgaaccgcctgaagccgctggaggactccaccatggagacgtcactgcggcgctgcctgtccacactggacctgactcttctgggcgtgggtggcatggtgggctcgggtctctacgtgctcacaggtgccgtggccaaggaggtggctggccctgctgtgctcttgtccttcggtgtggccgctgtggcctccctgctggcagccctatgctatgcagaatttggggcacgtgtgccacgcacgggctctgcctacctgttcacctacgtatccatgggcgagctgtgggccttcctcatcggctggaatgttctcctcgaatacatcatcggtggcgccgccgtggcccgtgcctggagtggctacctggactctatgttcagccacagcatccgcaacttcactgagacccacgtgggttcttggcaggtgcccctcctgggccactacccggacttcctggctgctggcatcatcctcctggcctctgcctttgtctcctgtggagcccgcgtgtcctcctggctcaatcacaccttctcggccatcagcctgcttgtcattctcttcattgtcatcctgggcttcatcctggcccagcctcacaactggagcgctgacgaaggcggctttgcacccttcggcttctccggcgtcatggccggcactgcctcctgcttctatgctttcgtgggcttcgacgtcattgccgcctccagtgaggaggcccagaacccacggcggtctgtgcctctggccatcgccatctcgcttgccattgcagctggtgcctacatccttgtctccaccgtgctaaccctcatggtgccctggcacagcctggaccccgactcagcgcttgcagatgccttctaccagcggggctacaggtgggctggcttcatcgtggcagctggctccatctgcgccatgaacaccgtcctgctcagcctcctcttctccctgccacgcattgtctatgccatggccgccgatgggctcttcttccaggtgtttgcccatgtgcacccccggacacaggtgcctgtggcgggcaccctggcgttcgggctcctcacggccttcctggcactgctgctggacctggagtcgctggttcagttcctgtcccttggcacactcctggcctacacattcgtggccaccagtatcattgtgctgcgcttccagaagtcttccccgcccagctccccaggcccagccagccctggccccctgaccaagcagcagagctccttctcagaccacctacagctggtgggcactgtacacgcctccgtccctgagccaggggagctgaagccagccctgaggccctacctgggcttcttggatgggtacagccctggagcagtggtgacttgggcgcttggcgttatgttggcctcagccatcaccataggctgcgtgcttgtctttgggaactcgaccctgcacctcccacactggggttacatcctgctgctcctgctcaccagtgtcatgtttctgctcagcctccttgtcctgggggctcaccagcaacagtatcgggaagacttatttcagatccccatggttcccctgattccagccctgagcatcgtcctcaacatctgcctcatgctgaaacttagctatctgacctgggtgcgcttctccatctggctgctgatgggacttgcagtgtatttcggctatggcatccggcatagcaaggagaaccagcgggagctgccagggctgaactccacacactacgtggtattccccaggggcagcctggaggagacagtgcaggctatgcagccccccagccaggcaccagcacaggaccctggccatatggagtagctgatcagcccacacttgccccgccctcccacacctgcttgggaggccagagaggccagacaagccgagagccccttctgttgtgggcagcctgggtttgcaggcctgcacaggctggggagtcctcaggaccttaggaccttcatccaggggctgggcttcgggtcttcaggagtgggccttggctggtgctggtgccatggactctgcccagagccttcttgtttatgatcagctccagctacctgggcagttgtggtggggtggatgggaaggcccacagcccaagggatccataataataattgcttggccagccatgtggcctgctggcgtaaaaaaa

SEQ ID NO: 291449 - DNA, 577 bp, Homo sapiens
ctcctgggccactacccggacttcctggctgctggcatcatcctcctggcctctgcctttgtctcctgtggagcccgcgtgtcctcctggctcaatcacaccttctcggccatcagcctgcttgtcattctcttcattgtcatcctgggcttcatcctggcccagcctcacaactggagcgctgacgaaggcggctttgcacccttcggcttctccggcgtcatggccggcactgcctcctgcttctatgctttcgtgggcttcgacgtcattgccgcctccagtgaggaggcccagaacccacggcggtctgtgcctctggccatcgccatctcgcttgccattgcagctggtgcctacatccttgtctccaccgtgctaaccctcatggtgccctggcacagcctggaccccgactcagcgcttgcagatgccttctaccagcggggctacaggtgggctggcttcatcgtggcagctggctccatctgcggtgagagactcttcctgggcagggtggcagggaaaagagcaagggggaccttgtcctcagattcttggggaatgcaccttcaac

SEQ ID NO: 291450 - DNA, 513 bp, Homo sapiens
tgagatggagtcttgctctgtcgaccaggctggagggtagtggggtgatctcagctcattgtaacctccacctcctgggttcatgcaattctcctgcctcagcctcccgagtagctgggattacaggcacgagccacctcgcccacccaagatcatgacttttcaacaccactcagtctgtgggtcactaatgaattgccacattgaaccataaaagcagagggctgcaaagcaaactttctagtactacctacttggcttgagccatgttccgagtgagaatgaagggtttcactggaggcctctcctggcgagatgagttagaagttgatgcctaagaaggaaattaattatgagaggtgaatttgccattttacccaacataccatacgggctcttaagtcttcaggtgcttgaaaagctctggattcaaaattcactcactttctatttatcagtctctaagatatagcagcagaacactaacggtagagattccttagctctcctgag

SEQ ID NO: 291451 - DNA, 271 bp, Homo sapiens
ccttccagctggctgcagctgcatagagaaaaagaagacatgaggagatggagggtgtggtgttgcgggaagtcagggaccccaaacggagggaccggctgaagccatggcagaacgtggattgtgaagacttcatggacatttattagttccccaaattaatacttttataatttcctatacctgtctttactgcaatcttggaacataaaattgtgaagatttcatggacacttaccacttccccaatcaatacccttgtgatttccta

SEQ ID NO: 291452 - DNA, 1103 bp, Homo sapiens
tgtgttacttcccccagtggaaaggaaaagggcccataggagctgaatctgactttgggaccctcagtgggtgaggtggtgagcccgcagtgacgtacgcaatgcctgtcacagtgcaggctaaaaccacaggctataaccaatagcagtaactgaaaaacaaaataaagctaaaagcagtgctgtacaatcagctccaggagattttccacattcatccttttcgcttacactctacacttacttgaatgcattcacggccactactactggaattccaaacattctggcattttcaatttgtttcttcaagttactgaagcctttttcaaccagctccaggttctgtaaaaacaacagtgaaaggcctatgagatcagagagttgaaaaccactgcaggttcttcttcaaaggcaaacaacctccttgagccagcagccactcactatcaggacaaggaggccaagaaagaagagagaaggtcccttggtgcattttttccagtgcggtgagtggatgctatggagaactgcagctttcactccagcctatgacactagagtagagctctgcttgtttcccagccttcaagaaaaaaagagctggtatgtttcctgtcattatgccacatcattatagcttatttgctgtttgaaaggaattagttacccttacccaaattatatttaccaattgtgtttatagattttatgtattcatagggttatgataatacaaattaactctactctgcacagcacagacccttccatcagaagacagagcctaacaacatagtggctggcacagaagaggtattcgttatatggctgccgtaaatactgccaggaaatatgaagtaagcagtgatgttttcaaaggttttaatgaactcgaccgtgaacgagggcaagaaataagataaatactatctttaggaatcaggccagtggctgggcccagtggctcacacttgtaatcccaggactttgggaggctgaggcaggagaatccacttgagcccaggagtttgagacaagcctaggaaacataacaagaccccatctctacaactgagaagttaattaaaaaaaaaaaaaaa

SEQ ID NO: 291453 - DNA, 555 bp, Homo sapiens
tgtgttacttcccccagtggaaaggaaaagggcccataggagctgaatctgactttgggaccctcagtgggtgaggtggtgagcccgcagtgacgtacgcaatgcctgtcacagtgcaggctaaaaccacaggctataaccaatagcagtaactgaaaaacaaaataaagctaaaagcagtgctgtacaatcagctccaggagattttccacattcatccttttcgcttacactctacacttacttgaatgcattcacggccactactactggaattccaaacattctggcattttcaatttgtttcttcaagttactgaagcctttttcaaccagctccaggttctgtaaaaacaacagtgaaaggcctatgagatcagagagttgaaaaccactgcaggttcttcttcaaaggcaaacaacctccttgagccagcagccactcactatcaggacaaggaggccaagaaagaagagagaaggtcccttggtgcattttttccagtgcggtaagagacacatatctttgactacatgactaaacgcagcactggt

SEQ ID NO: 291454 - DNA, 1213 bp, Homo sapiens
aacgccactccacgacatccctaggccggcgacacgccgctctcaagcctgtggatgacccagcgccagaaaaccgggtggccgtcatgaagccctagcccagctccgcagcccctcaccttatagacggccacacaggctgaggtgcagcccaggtaaagaagcttgtgtaatcgcagaggaaggacataacagtttgagcctcactctgtcacccaggttggagtacagtggaacagtctcagctcactgcaacttccgtcttccaggctcaagtgatcctccctcctcagcctcctgagtagctggactacagtatgtaaagaattcttgaaccgattctacaagtcactgatagacagaggagttaacttttcgctggacactatagagaaagaattgatcagtttttgcttggacaccaaaggaaaagaaaaccgcctgtgctattatctaggagccacaaaagacgcagccacaaagatcctaagtgaagtcactcgcccaatgagtgtgcatatgcctgcaatgaagatttgtgagaagctgaagaagttggatagccagatctgtgagctgaaatatgaaaaaacactggacttggcatcagttgacctgcggaagatgagagtggcagagctgaagcagatcctgcatagctggggggaggagtgcagggcctgtgcagaaaaaactgactatgtgaatctcattcaagagctggcccccaagtatgcagcgacacaccccaaaacagagctctgatctccaatgccagcacatttgtgacttgtaattagagagaaaagtgactctctaggatatggacatgttgattaaggataactgggaatgcatcatatttggtctcatgctttttgtgttggtattattcctcagaattttgttacgtgggtttatgagtgaaactaatactactgataacttacatttgcagtgtaccaaaagctaaaagttcctttctcataagtttcttggaatgactatgccagttttcattgcctgtctcctaaaagtgacctactgacaaattgatggagtaaattgattccaagaaagaagaaggcattcagagactcctctctggatgcaattttaaaatatattggactaaaacaaaagacacaacagtcagcttatctaatgcacaacttcaatcccaaatacagaatcaaaagtttttttcaagtga

SEQ ID NO: 291455 - DNA, 1145 bp, Homo sapiens
gtgttcagttgcgtcatttgtcctggcaactactggcagattctttccaacctcgaattctgctcagctcgctttggcagcttggtgggcggtgggcgcgggtggcggaggcgattgaagctgctggcccagcatgtggtgcgcgagcccagttgctgtggtggccttttgcgccgggcttttggtctctcacccggtgctgacgcagggccaggaggccggggggcggccaggggccgactgtgaagtatgtaaagaattcttgaaccgattctacaagtcactgatagacagaggagttaacttttcgctggacactatagagaaagaattgatcagtttttgcttggacaccaaaggaaaagaaaaccgcctgtgctattatctaggagccacaaaagacgcagccacaaagatcctaagtgaagtcactcgcccaatgagtgtgcatatgcctgcaatgaagatttgtgagaagctgaagaagttggatagccagatctgtgagctgaaatatgaaaaaacactggacttggcatcagttgacctgcggaagatgagagtggcagagctgaagcagatcctgcatagctggggggaggagtgcagggcctgtgcagaaaaaactgactatgtgaatctcattcaagagctggcccccaagtatgcagcgacacaccccaaaacagagctctgatctccaatgccagcacatttgtgacttgtaattagagagaaaagtgactctctaggatatggacatgttgattaaggataactgggaatgcatcatatttggtctcatgctttttgtgttggtattattcctcagaattttgttacgtgggtttatgagtgaaactaatactactgataacttacatttgcagtgtaccaaaagctaaaagttcctttctcataagtttcttggaatgactatgccagttttcattgcctgtctcctaaaagtgacctactgacaaattgatggagtaaattgattccaagaaagaagaaggcattcagagactcctctctggatgcaattttaaaatatattggactaaaacaaaagacacaacagtcagcttatctaatgcacaacttcaatcccaaatacagaatcaaaagtttttttcaagtga

SEQ ID NO: 291456 - DNA, 294 bp, Homo sapiens
tgaatctgcagatgcagaacccactgatagagagggctgctgtaccacattttccttgggtgtgtcttggtttccatggaaactggaattcttccctgccttggatcatagggtagtcagcaccaagataagcaaactatatgccttttgaagtgattcatagggattttttttccatttattttgtaattggcttttttcctttttgccatttaggtgagctgaaatatgaaaaaacactggacttggcatcagttgacctgcggaagatgagagtggcagagctgaagcaga

SEQ ID NO: 291457 - DNA, 343 bp, Homo sapiens
agcccagttgctgtggtggccttttgcgccgggcttttggtctctcacccggtgctgacgcagggccaggaggccggggggcggccaggggccgactgtgaaggtgagcggtgtgacaactgcttgcatggcggcggccccgcgctgcggcgcagcagctgtcggctttggcttctcctggccctggctataaataacattccgcccaggaaatgcaggccctgtccctcgttttagatcgcccaagcccagctcgagtaaaaagctcaagccgggcctggtggtaacgtgaggccacgttgtggttttgctgtgaatattaaacttcagcagtaaaagctgg

SEQ ID NO: 291458 - DNA, 1535 bp, Homo sapiens
gcgtgtaacgtgcgctatggagccgaaagtcgcagagctgaagcagaagatcgaggacacgctatgtccttttggcttcgaggtttaccccttccaggtggcatggtacaatgaactcttgcctccagccttccacctaccgctgccaggacctaccctggccttcctggtactcagcacgcctgccatgtttgaccgggccctcaagcccttcttgcagagctgccacctccgaatgctgactgacccagtggaccagtgtgtggcctaccatctgggccgtgttagagagagcctcccagagctgcagatagaaatcattgctgactacgaggtgcaccccaaccgacgccccaagatcctggcccagacagcagcccatgtagctggggctgcttactactaccaacgacaagatgtggaggctgacccatgggggaaccagcgcatatcaggtgtgtgcatacacccccgatttgggggctggtttgccatccgaggggtagtgctgctgccagggatagaggtgccagatctgccacccagaaaacctcatgactgtgtacctacaagagctgaccgtatcgccctactcgaaggcttcaatttccactggcgtgattggacttaccgggatgctgtgacaccccaggagcgctactcagaagagcagaaggcctacttctccactccacctgcccaacgattggccctattgggcttggctcagccctcagagaagcctagttctccctccccggaccttccctttaccacacccgcccccaagaagcctgggaatcccagcagagcccggagctggctcagccccagggtctcaccacctgcatcccctggcccttgattttctcccatgtggaccctgatttatggtggtacttgctaggacttaattggctttggcaaagcaaaaggttttgagtacaagattactatttttgataatatagtagagatcttccatgaagataacaagactatctctaatcaaggctagaaccaagggaaggctaagaattgcccagtactgtgcaactactgaaagccctacccaaggccaccagccttgtcttcctctttcctctgtcagttcaaaaagaacagaaacctccagctcttttacatagcaggtaccaggcatttatcagaagaggccaagcttctggttcccatgcagccctttgaatagtgtgtctaaacaaaaataggtgtccaagtagtcacactgagactttaactggtaacccagcctgtggcgtcagtcgcagtgctctggccaacactatagcagggcttattcttctccctcatgtgtagtgaaacaaaatgtaacaccttgggttcattcagttccattccctatgtctacctgtgtcaatataattccctgatttggaggcagctctcctcattttccccaaaacagggaaagcaaggagtaaattcctcttaaaatcaaaagctaataatatgcttcctaaaataaagactcatcaaggtctcagttcaagttt

SEQ ID NO: 291459 - DNA, 1168 bp, Homo sapiens
agacagagtcttactctgtcacctaggctggagtgcagtggcacagtctctactcactgcaacctctgcctcctgggctgaggcagtagaatcatttgaaccagggaggcagagattgcagtgagccgagattgcatggctgcactctagcctgggtgacagtgtgagactctgtctcaaaaaaaaaaaaaaaagtacctacctcaggtagggactgaataaacacgtgtaaggcactttggaaaaatacctggcatatatagtaagcagtatgttggccattaccaaaggccctgggaattctgtactgctgctcatgggtgtagtcggttctagaggggtgggcaggtgggagtagctgaggaagacaagtggctggaatggtatcacatgatacacagaagtatcctcagttctgaatctaccttggcctcaagggcccaggagaataacttttcccagctgacagcctctctgaggacaatgacatatgaatgaggatcaaaacgagctttggccaggcactgtggcgctcacctgtaatcccaccattttgggaggctgaggcggaggaccacctgaggcaaggaattcagaaccactctgggcaacataatgacactaaaaaagactatctctaatcaaggctagaaccaagggaaggctaagaattgcccagtactgtgcaactactgaaagccctacccaaggccaccagccttgtcttcctctttcctctgtcagttcaaaaagaacagaaacctccagctcttttacatagcaggtaccaggcatttatcagaagaggccaagcttctggttcccatgcagccctttgaatagtgtgtctaaacaaaaataggtgtccaagtagtcacactgagactttaactggtaacccagcctgtggcgtcagtcgcagtgctctggccaacactatagcagggcttattcttctccctcatgtgtagtgaaacaaaatgtaacaccttgggttcattcagttccattccctatgtctacctgtgtcaatataattccctgatttggaggcagctctcctcattttccccaaaacagggaaagcaaggagtaaattcctcttaaaatcaaaagctaataatatgcttcctaaaataaagactcatcaaggtctcagttcaagttt

SEQ ID NO: 291460 - DNA, 2494 bp, Homo sapiens
gcgtgtaacgtgcgctatggagccgaaagtcgcagagctgaagcagaagatcgaggacacgctatgtccttttggcttcgaggtttaccccttccaggtggcatggtacaatgaactcttgcctccagccttccacctaccgctgccaggacctaccctggccttcctggtactcagcacgcctgccatgtttgaccgggccctcaagcccttcttgcagagctgccacctccgaatgctgactgacccagtggaccagtgtgtggcctaccatctgggccgtgttagagagagcctcccagagctgcagatagaaatcattgctgactacgaggtgcaccccaaccgacgccccaagatcctggcccagacagcagcccatgtagctggggctgcttactactaccaacgacaagatgtggaggctgacccatgggggaaccagcgcatatcaggtgtgtgcatacacccccgatttgggggctggtttgccatccgaggggtagtgctgctgccagggatagaggtgccagatctgccacccagaaaacctcatgactgtgtacctacaagagctgaccgtatcgccctactcgaaggcttcaatttccactggcgtgattggacttaccgggatgctgtgacaccccaggagcgctactcagaagagcagaaggcctacttctccactccacctgcccaacgattggccctattgggcttggctcagccctcagagaagcctagttctccctccccggaccttccctttaccacacccgcccccaagaagcctgggaatcccagcagagcccggagctggctcagccccagggtctcaccacctgcatcccctggcccttgattttctcccatgtggaccctgatttatggtggtacttgctaggacttaattggctttggcaaagcaaaaggttttgagtacaagattactatttttgataatatagtagagatcttccatgaagataacaagactatctctaatcaaggctagaaccaagggaaggctaagaattgcccagtactgtgcaactactgaaagccctacccaaggccaccagccttgtcttcctctttcctctgtcagttcaaaaagaacagaaacctccagctcttttacatagcaggtaccaggcatttatcagaagaggccaagcttctggttcccatgcagccctttgaatagtgtgtctaaacaaaaataggtgtccaagtagtcacactgagactttaactggtaacccagcctgtggcgtcagtcgcagtgctctggccaacactatagcagggcttattcttctccctcatgtgtagtgaaacaaaatgtaacaccttgggttcattcagttccattccctatgtctacctgtgtcaatataattccctgatttggaggcagctctcctcattttccccaaaacagggaaagcaaggagtaaattcctcttaaaatcaaaagctaataatatgcttcctaaaataaagactcatcaaggtctcagttcaagtttaatacaaactacaaaagattaatgggttgctctactaatacatcatacaaaccagtagcctgcccacaacgccaactcaggccattcctaccaaaggaagaaaggctggtctctccaccccctgtaggaaaggcctgccttgtaagacaccacaattcggctgaatctgaagtcttgtgttttactaatggaaaaaaaaaatacagaagaggttttgttctcatggctgcccaccgcagcctggcactaaaacagcccagcgctcacttctgcttggagaaatattctttgctcttttggacatcaggcttgatggtatcactgccaggtttccagccagctgggcacactgcaagagaaaggcaccactaattaataaccttctcaatggtatgcaccaccattctcctatggacaaaaccagttctgcacctgaacactcagataccaggaaacctacccctgcaatcagtcttagatcattcacccttttagtatgagctaaccattttacaaacatataatcatcaccacagccttaagatactatcatgcctaatttattcatgtagcacttgaaatttaaattttccacaaaaaaaggcaaagtttaaataatttgccaacactctctaatccttaaggggaaaaaaaagctaaataaacgacacacataggactatgtaaacccttaacactaaactgtttctgacagcccttcagagctctgaagacagcaaactcagtctgccttctcagcattcttctaactctaccaaactggatagcctgaaccttataaaggatcaagaacttaacagaagcccccgcttgtttcattaagtaactgccatctaccccttggtaagcaaaaggcagagtttgaaatttttcatagatttatacagaaagcacagccttcaaccttttcctgacaatgcctaagaatgtgcctcagg

SEQ ID NO: 291461 - DNA, 2349 bp, Homo sapiens
gcgtgtaacgtgcgctatggagccgaaagtcgcagagctgaagcagaagatcgaggacacgctatgtccttttggcttcgaggtttaccccttccaggtggcatggtacaatgaactcttgcctccagccttccacctaccgctgccaggacctaccctggccttcctggtactcagcacgcctgccatgtttgaccgggccctcaagcccttcttgcagagctgccacctccgaatgctgactgacccagtggaccagtgtgtggcctaccatctgggccgtgttagagagagcctcccagagctgcagatagaaatcattgctgactacgaggtgcaccccaaccgacgccccaagatcctggcccagacagcagcccatgtagctggggctgcttactactaccaacgacaagatgtggaggctgacccatgggggaaccagcgcatatcaggtgtgtgcatacacccccgatttgggggctggtttgccatccgaggggtagtgctgctgccagggatagaggtgccagatctgccacccagaaaacctcatgactgtgtacctacaagagctgaccgtatcgccctactcgaaggcttcaatttccactggcgtgattggacttaccgggatgctgtgacaccccaggagcgctactcagaagagcagaaggcctacttctccactccacctgcccaacgattggccctattgggcttggctcagccctcagagaagcctagttctccctccccggaccttccctttaccacacccgcccccaagaagcctgggaatcccagcagagcccggagctggctcagccccagggtctcaccacctgcatcccctggcccttgattttctcccatgtggaccctgatttatggtggtacttgctaggacttaattggctttggcaaagcaaaaggttttgagtacaagattactatttttgataatatagtagagatcttccatgaagataacaagactatctctaatcaaggctagaaccaagggaaggctaagaattgcccagtactgtgcaactactgaaagccctacccaaggccaccagccttgtcttcctctttcctctgtcagttcaaaaagaacagaaacctccagctcttttacatagcaggtaccaggcatttatcagaagaggccaagcttctggttcccatgcagccctttgaatagtgtgtctaaacaaaaataggtgtccaagtagtcacactgagactttaactggtaacccagcctgtggcgtcagtcgcagtgctctggccaacactatagcagggcttattcttctccctcatgtgtagtgaaacaaaatgtaacaccttgggttcattcagttccattccctatgtctacctgtgtcaatataattccctgatttggaggcagctctcctcattttccccaaaacagggaaagcaaggagtaaattcctcttaaaatcaaaagctaataatatgcttcctaaaataaagactcatcaaggtctcagttcaagtttaatacaaactacaaaagattaatgggttgctctactaatacatcatacaaaccagtagcctgcccacaacgccaactcaggccattcctaccaaaggaagaaaggctggtctctccaccccctgtaggaaaggcctgccttgtaagacaccacaattcggctgaatctgaagtcttgtgttttactaatggaaaaaaaaaatacagaagaggttttgttctcatggctgcccaccgcagcctggcactaaaacagcccagcgctcacttctgcttggagaaatattctttgctcttttggacatcaggcttgatggtatcactgccaggtttccagccagctgggcacacttccccatgtttgtcagtgaactggaaggcctgaactagtctcaaagtctcatccacagagcggccaacagggaggtcatttacagtgatctgccgaagaatacccttatcatcaatgataaaaaggcccctgaacgagatgccttcatcagcctttaagaccccataatcctgagcaatggtgcgcttcgggtctgataccaaaggaatgttcatgggtcccagtcctccttgtttcttaggtgtattgacccatgctagatgacagaagtgagaatccacagaagcaccaatcacttggcagttgagtttcttaaattcttctgccctatcactgaaagcaatgatctcccctttgtagtcagacaggctgatatctttaaactgaccatctggcataacagctgtggctttgaagttgggggcagggtgcccaattttagcatttcctgaagacatcttcc

SEQ ID NO: 291462 - DNA, 315 bp, Homo sapiens
gggacctccatgaccttgcttttcttcaccctctccccagcgcatatcaggtgtgtgcatacacccccgatttgggggctggtttgccatccgaggggtagtgctgctgccagggatagaggtgccagatctgccacccagaaaacctcatgactgtgtacctacaagagctgaccgtatcgccctactcgaaggcttcaatttccactggcgtgattggacttaccgggatgctgtgacaccccaggagcgctactcagaagagcagaaggcctacttctccactccacctgcccaacgattggccctattggg

SEQ ID NO: 291463 - DNA, 4008 bp, Homo sapiens
  misc_feature (181)..(181): n is a, c, g, or t
  misc_feature (254)..(254): n is a, c, g, or t
  misc_feature (266)..(266): n is a, c, g, or t
  misc_feature (2706)..(2706): n is a, c, g, or t
cgcgcgcccgggggagcgcagagtttggaaagtcttcgagaagcttcagaggagggaagggggtgggaagagtgggggtgcaagagagaaaaacccgcctcttgcgagttgagcgaggaagaggggggggaaggctccgagttccgcttcctgaacggcgggtggatagagaaggttggcncggggaagaccggcgggaggcgcgccccgggcccgcggcgcgattggcgtgaccggcgatggccggtgagcgnacccgcaggttnacccggagcctgttgagacctggcaggcgccgagctccggcacagcctgccgcgtccgccgccgcggtggcagtcagcagccggcagcagcagcggcaagaaaagcctaggcttctcgagcctttggattatgagactgtcattgaagaacttgaaaagacctaccggaatgatcctcttcaagatctcttgttcttccccagtgatgacttttcagcagccacagtttcctgggatatccgcacgttgtactcaacagtacctgaagatgcagagcacaaggcagaaaatttactggttaaggaggcttgtaaattttatagttcccagtggcatgtggtaaactacaaatatgaacaatattctggagacattcgacagctaccccgagcagaatacaaaccagagaagcttccttcacattcctttgagattgaccatgaagatgctgataaggatgaagataccacttcccactcgtcttccaaggggggtggaggagcgggaggaactggtgttttcaagtccggctggctctacaaggggaattttaacagcaccgtgaacaacaccgttactgttcggtcattcaaaaagcgctacttccagctgactcagttaccagataactcctacattatgaacttttacaaagatgagaaaatatccaaagaacccaaaggatgcatctttttggattcctgtacaggagtggtgcagaataacagactaagaaaatatgcctttgaattgaaaatgaatgatctgacctattttgtgctggcagctgaaacagagtcagatatggatgaatggatccacaccctcaaccgcattctgcaaatcagtcctgaggggcccctccaagggaggaggagcacagagctcactgatctgggtctggattcgctggataattctgtaacttgtgaatgcacgccagaggaaacagattcttcagagaacaacctacacgcagactttgcaaagtacctcacagaaacagaagatactgtaaaaacaactcgaaacatggagaggctaaatctgttctctctagatccagacatagataccttgaaacttcaaaaaaaagatctcttggaacctgagtctgtgatcaaaccatttgaagaaaaagctgccaagagaatcatgatcatctgtaaagccctcaactcaaatcttcagggatgtgttacggagaatgaaaatgatccgataacgaatattgagcctttttttgtgagtgtggcactttatgacctcagagacagcaggaagatttctgctgattttcatgtggatctaaaccatgctgctgtcagacagatgctcttgggggcttctgtggctttggaaaatggcaacatcgacaccatcactccaagacaatcagaagaacctcacatcaagggacttccagaggaatggctaaaatttccaaagcaggctgtattttctgtaagcaatccacattctgaaattgttttggtggccaaaatcgaaaaagtcttgatgggaaacattgcaagtggtgccgaaccttatattaagaacccagactccaacaagtatgcacaaaagatactaaaatccaacagacaattctgcagcaaattgggaaaataccgtatgccttttgcttgggcagtaaggtatgttgacagttgcagccaacagactagaaatacatttaatggtggcattggaagcttcagttttgaacgtttttgtgttgcctattatttttaatgtgtctacacctagaaaatcctaatatggtcatcttcataaacatcttgagcttctctgagacatacatttcacaagacagtttagcaatacagtttataatagagggccgtgacacatgtaccctgcatgcatgaccagatatgctatgggttcttggtagatatcaaatcaatgtcataaattgtttattatgtatatttgacttaacaaacctttgacattatgtcagtcctgagagtctggtgtgcctaaaattcagatagatgcactgtaatttcttatgcagctgtttgttttcatttatgcgtagagctcaggtctatatatggacgtccaaatgaaaccatcaaaccaatcatttaaactcattttgattttgatactgtttagcccagccaaatttatcagtaccagttgcctctgaaagaaagtctgagttctgtggacatagatggacacatcattcacttggatgcatgacctcttcatgaagaaccataattgcttttcagaactgtttaatcatcaattatgattgtcctcatcaatctctttacatctttattagtgtaagaatttcttaagtgaggaagagcctggcatagactcataaggctaaaaggtcatcaatgtacacactgaatgaactaagaaaggttagagctaccagccgggcatggtngctcacgcctgtaatcccagcactttgggaggccaagacaggcggatcccgaggtcaggagttcgagaccagcttggccaacatggtgaagctctgtctctactaaaaatacaaaaattagccaggtgtggtggcaaataagacagcccatcaagtattcatttgaactttgctgacattatctcaatgtatccaactttagcatccagaaggaagagagaacctgttaattatgccatttttaagtctcacagttcccagtgatgtatattcagagtaaactcaccaatatttgtcataattttgaggttgttatttaaagttggagatgagtaggtgtaggaaggagaaatgtggaagtttgggcagcagtaaatcaagatagattcatgcagtctccaggaattcgtttgccctaaggcagcgtcatagcaagggagggagagtccaggcctgggagtctaataaacgttgcagatcaggccactacttactgtgacttggaacaagtttcttctccatgtctctgggtccccagctataaattgaagctgacaatacctgtgttatgagcagtatgtgcaatctcaagtgcacaagcatttggcgtaaaatagatcatgaatagtactttatcctcccttttctatctctttctataggaacaactaatgccaggacattctgcatgaaaaagatggtatttagatttgcagaaccctttataatgaatttgtttttatttctcataagctttaagacaaaggttaactaattataattcactgattaaacatttttggtattgttaagcattctcagttccctccagaaaacctactggggcaagtagaggcaagatgtctgttgtgaaatattccagtataacaaaattacaatagtgcacacatttttcactttaaggatccaacattgctctgaggttttagaaacaggcattttagaaccagacagagctgagctcaaaatatcctaactctggccaggcatggtggggcatgcctataatcccaatactttaggaggccaaggtctcctggaggttcacttaaggtcaggaattctagaccagcctgggcaacatagtgagacccaatctctaaaaacaacttttaaaaaattaaccaagggtggtagcatacacctgtagtcctagctactcaggaggctgagatgggagtatcagaatcatcagagatgagcccagaagctggaagttgcaatgaactatgatagcaccactgcactccagcctgggcaacagagtgagaccctgtctct

SEQ ID NO: 291464 - DNA, 967 bp, Homo sapiens
  misc_feature (181)..(181): n is a, c, g, or t
  misc_feature (254)..(254): n is a, c, g, or t
  misc_feature (266)..(266): n is a, c, g, or t
cgcgcgcccgggggagcgcagagtttggaaagtcttcgagaagcttcagaggagggaagggggtgggaagagtgggggtgcaagagagaaaaacccgcctcttgcgagttgagcgaggaagaggggggggaaggctccgagttccgcttcctgaacggcgggtggatagagaaggttggcncggggaagaccggcgggaggcgcgccccgggcccgcggcgcgattggcgtgaccggcgatggccggtgagcgnacccgcaggttnacccggagcctgttgagacctggcaggcgccgagctccggcacagcctgccgcgtccgccgccgcggtggcagtcagcagccggcagcagcagcggcaagaaaagcctaggcttctcgagcctttggattatgagactgtcattgaagaacttgaaaagacctaccggaatgatcctcttcaagatctcttgttcttccccagtgatgacttttcagcagccacagtttcctgggatatccgcacgttgtactcaacagtacctgaagatgcagagcacaaggcagaaaatttactggttaaggaggcttgtaaattttatagttcccagtggcatgtggtaaactacaaatatgaacaatattctggagacattcgacagctaccccgcgagggtccataggaagatactgaagaaatagatgacttcaggctagaatggaaaatgtaagcctttacacactaggaatagaaatcagcactaacttggagatcccagaagaaaaaagcagcataaaaatatatgatgccactgatttcattaatccactgggtaaaatacagagatgtgtgacatattaaaattttttaccatggtcgatttgatagaaagaagatgtaaggaagaaaaattcataagagtataaattgtgactaaagatcaaataaagtgtgaccagcttagctgggctgaaataaaaa

SEQ ID NO: 291465 - DNA, 1877 bp, Homo sapiens
tgcgagaagacacgtgcgcggaaggagcttgcagtagcgggcggcagagctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagagtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttggaaacaagaaaaaaattat

SEQ ID NO: 291466 - DNA, 1561 bp, Homo sapiens
tgcgagaagacacgtgcgcggaaggagcttgcagtagcgggcggcagagctggagtgaagggagctagtgtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttggaaacaagaaaaaaattat

SEQ ID NO: 291467 - DNA, 1543 bp, Homo sapiens
aggactcgagctcaagctttttttccagtgagcagagtgaagggagctagtgtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttggaaacaagaaaaaaattat

SEQ ID NO: 291468 - DNA, 455 bp, Homo sapiens
tgcgagaagacacgtgcgcggaaggagcttgcagtagcgggcggcagagctggagtgaagggagctagtgtttaggtagcagtcaccattatgctcaaagcggtgatcctgattggaggccctcaaaagggaactcgcttcagacctttgtcttttgaggtgcccaaaccattgtttcctgtggaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttggaaacaagaaaaaaattat

SEQ ID NO: 291469 - DNA, 619 bp, Homo sapiens
  misc_feature (12)..(12): n is a, c, g, or t
  misc_feature (19)..(19): n is a, c, g, or t
  misc_feature (596)..(596): n is a, c, g, or t
atcgagctcgtnccaatgnagggactcgggggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctggctcccgagtccnctgcattggtaccgagcatcgat

SEQ ID NO: 291470 - DNA, 951 bp, Homo sapiens
  misc_feature (823)..(823): n is a, c, g, or t
  misc_feature (850)..(851): n is a, c, g, or t
  misc_feature (854)..(854): n is a, c, g, or t
tgcgagaagacacgtgcgcggaaggagcttgcagtagcgggcggcagagctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagagtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagcctctagnctcccgctctactgagcggtacagganntcnccagaaggtggcaagcacacccaaggggcatggtccagggtgtttcactcccggacgcagtgccttgtggtgggccagtccgaaggggacgggaggg

SEQ ID NO: 291471 - DNA, 579 bp, Homo sapiens
aatggggcagggtggaagcaggctctgcctggggctccttgtgatagcaccacccaagtgggggctgggtgggagaggtcctgggatgtgagcagccacatcccagagagggccgaaccagacctggagagaggggcttagagaggtggtgggaatcctcctactcctgtccctgggagactgtgttagccccacagtcggggctcagctgggggactaatgtcagcattcttcctctctgccagggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagcctctgtccagaaaggaccagagaaagccaggctggatcgtcacatgccggggagcaatgtggatggcctggggactcctgggttttctccctcccgactccctaataaaccccgtgaaccttggaaacaagaaaaaaattat

SEQ ID NO: 291472 - DNA, 590 bp, Homo sapiens
  misc_feature (229)..(229): n is a, c, g, or t
  misc_feature (233)..(233): n is a, c, g, or t
  misc_feature (249)..(249): n is a, c, g, or t
  misc_feature (251)..(252): n is a, c, g, or t
  misc_feature (290)..(290): n is a, c, g, or t
  misc_feature (315)..(315): n is a, c, g, or t
  misc_feature (328)..(328): n is a, c, g, or t
  misc_feature (347)..(347): n is a, c, g, or t
  misc_feature (359)..(359): n is a, c, g, or t
  misc_feature (363)..(363): n is a, c, g, or t
  misc_feature (366)..(366): n is a, c, g, or t
  misc_feature (384)..(384): n is a, c, g, or t
  misc_feature (386)..(386): n is a, c, g, or t
  misc_feature (388)..(388): n is a, c, g, or t
  misc_feature (390)..(390): n is a, c, g, or t
  misc_feature (401)..(401): n is a, c, g, or t
  misc_feature (415)..(415): n is a, c, g, or t
  misc_feature (426)..(426): n is a, c, g, or t
  misc_feature (446)..(446): n is a, c, g, or t
  misc_feature (465)..(465): n is a, c, g, or t
  misc_feature (499)..(499): n is a, c, g, or t
  misc_feature (508)..(508): n is a, c, g, or t
  misc_feature (523)..(523): n is a, c, g, or t
  misc_feature (526)..(526): n is a, c, g, or t
  misc_feature (528)..(528): n is a, c, g, or t
  misc_feature (558)..(558): n is a, c, g, or t
tgcgagaagacacgtgcgcggaaggagcttgcagtagcgggcggcagagctggagtgaagggagctagtgtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccagncccnggaaggcaggagatgntnntcagggtgcggcgaccaacctgagtgagctccgcatcnagggtcctagtaatgccgcccatcnggagtggaaccgnccaggcagtgaccggcagnaaggggcccccntatncanatgggggggtctgtgacnantntnctatatcattnctctgttcgggganccccgaggcangcggcggtcgcaagtcgganggcggcgccgatggccccnggagggcgaggggtggaatccttaccgatgccancggcacccnggcggacgccggggnacnanggcgaacatttatctcaagcccgcaatganggcgtcagtcggggataaagccacatacacac

SEQ ID NO: 291473 - DNA, 530 bp, Homo sapiens
catagccctgtgaccccaagtacccccagtcacggaccccaacacataccagtctctgcaggctccatctcaacttgctcaccttcctcctcccctctcccttctccacttgccatctccagcagagcctcctgagtccctccccttctaacctcattctgtccctcttccttatccatcccagttcctcctctgtcactgcctgcccactccccttctggtccatttctcctaagccctgagtgtcccagagacgtctttcagaacagacagcaacacacagttgggcgcacacatgctcgggtgcagacgtgtgcacgtgcacacacagacagacatgcatactctcaggctgaggctccccttggaacatagcaccagagccctgctcaccagtcccagggtcttccctcctggggctagaagctgttcccttctagggatccttgccttaaccccccaccgccccatctaaggcctcctctgctcatagccatttctcactcccacccgtgtctctgcttccctct

SEQ ID NO: 291474 - DNA, 323 bp, Homo sapiens
aagtccctccagggcttatggtgtgtgcttctctccacagctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggtatggcttcctgggggccag

SEQ ID NO: 291475 - DNA, 1532 bp, Homo sapiens
ggacgcgtgggtcgacccacgcgtccggaagggagctagtgtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttggaaacaagaaaaaaattat

SEQ ID NO: 291476 - DNA, 1524 bp, Homo sapiens
tctgagcttgatttctctgttggaatttgaagttttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttggaaacaagaaaaaaattat

SEQ ID NO: 291477 - DNA, 1448 bp, Homo sapiens
tgcgagaagacacgtgcgcggaaggagcttgcagtagcgggcggcagagctggagtgaagggagctagtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttggaaacaagaaaaaaattat

SEQ ID NO: 291478 - DNA, 2148 bp, Homo sapiens
tgcgagaagacacgtgcgcggaaggagcttgcagtagcgggcggcagagctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagagtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtgtttgtgcacacactcgtatatgggggggtggggatgccctaggcctctgagttcttggaagtgggttgagtcagcatttgctggagttcatcctcgcctactagaaggattcttgtttggacatcaatgaatctctgagtatatagagtttctctgtgggccttgggcaggagtagtcctgggagcaagcggtggcggtcaggtgccctggctcatggtatctgtttcctaagatccactgagctggctctcgggtccctggggacaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttggaaacaagaaaaaaattat

SEQ ID NO: 291479 - DNA, 1795 bp, Homo sapiens
  misc_feature (1)..(1): n is a, c, g, or t
  misc_feature (16)..(16): n is a, c, g, or t
  misc_feature (20)..(20): n is a, c, g, or t
naattcggcactaggnagtnaagggagctagtgtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtgtttgtgcacacactcgtatatgggggggtggggatgccctaggcctctgagttcttggaagtgggttgagtcagcatttgctggagttcatcctcgcctactagaaggattcttgtttggacatcaatgaatctctgagtatatagagtttctctgtgggccttgggcaggagtagtcctgggagcaagcggtggcggtcaggtgccctggctcatggtatctgtttcctaagatccactgagctggctctcgggtccctggggacaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttggaaacaagaaaaaaattat

SEQ ID NO: 291480 - DNA, 1816 bp, Homo sapiens
tgcgagaagacacgtgcgcggaaggagcttgcagtagcgggcggcagagctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagagtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttggaaacaagaaaaaaattat

SEQ ID NO: 291481 - DNA, 2036 bp, Homo sapiens
tgcgagaagacacgtgcgcggaaggagcttgcagtagcgggcggcagagctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagagtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgaggtacccagcctgccccaattcctaacctttggcttccaccccagccctctgaaccaggattcttgacctcgagtccagagttaaagcctcaatccctgccccttcctgatcaaattcggtttgggatatttgcccccagggcctctcttctgcttctagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttggaaacaagaaaaaaattat

SEQ ID NO: 291482 - DNA, 1897 bp, Homo sapiens
tgcgagaagacacgtgcgcggaaggagcttgcagtagcgggcggcagagctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagagtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggcctctcttctgcttctagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttggaaacaagaaaaaaattat

SEQ ID NO: 291483 - DNA, 893 bp, Homo sapiens
  misc_feature (12)..(12): n is a, c, g, or t
  misc_feature (19)..(19): n is a, c, g, or t
atcgagctcgtnccaatgnagggactcgggggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttggaaacaagaaaaaaattat

SEQ ID NO: 291484 - DNA, 1096 bp, Homo sapiens
aatggggcagggtggaagcaggctctgcctggggctccttgtgatagcaccacccaagtgggggctgggtgggagaggtcctgggatgtgagcagccacatcccagagagggccgaaccagacctggagagaggggcttagagaggtggtgggaatcctcctactcctgtccctgggagactgtgttagccccacagtcggggctcagctgggggactaatgtcagcattcttcctctctgccagggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttggaaacaagaaaaaaattat

SEQ ID NO: 291485 - DNA, 1603 bp, Homo sapiens
  misc_feature (1580)..(1580): n is a, c, g, or t
tgcgagaagacacgtgcgcggaaggagcttgcagtagcgggcggcagagctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagagtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctggctcccgagtccnctgcattggtaccgagcatcgat

SEQ ID NO: 291486 - DNA, 1262 bp, Homo sapiens
tgcgagaagacacgtgcgcggaaggagcttgcagtagcgggcggcagagctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagagtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctactcctgcgccgttgtcagtgcccactttagatgtatctaattctcctgactgttcttcccaggggagtgtggaggtcttgttcctgttc

SEQ ID NO: 291487 - DNA, 993 bp, Homo sapiens
tgcgagaagacacgtgcgcggaaggagcttgcagtagcgggcggcagagctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagaggttagttttaggattcatgtttagcatatagaggatttttgctgggattaggggttcttcaaattcagatcagtgttagttcagtacttggggattacgttcaggatttaagttaaatatctgaggctcactcagggtttgctgtccaatattcagggttcactattggggttcagggcttaatatctagaatgaagacgcaacactttgggaatttgaggcttcagtattttgaggtttgggtctgagaagggagtctctgccaggtttctgaatttgcagaatttgttcatggccagagggaagtcttttagagatcaaattgtggggtgtgaatttcagaatttgggaggaatcactgtgaggtttgaaggccgactggaatctgggttgggatttgagatgtgtgggatttgtgaggttctgtccaggcagggactatattgagctttgggtttacatcttgggggagggctaagtgctgctatttggggtttggggtttggttggggtgtgagatctgagcttgatttctctgctgggatttgagatgtgtgggatttgtgaggtgttgggtccaggcagagactatattgagctttgggtt

SEQ ID NO: 291488 - DNA, 865 bp, Homo sapiens
tttatttgttcgtgctttaatataaaacatacatataaacacgcacacacacatgcatgtacacacctacacacatatagttttgtgctcagcaccaggtagctgtgagagaaacagagccaaatgggtgcagtccctgcctcttggttactgtgagtctaataggagtgacagaatcaaaaggcaacctttgcaaatgatacaatgccatgggtgaggcgtggccagagttcaggagtgcccaggcatgaacagctaactcgggccagcaagagaggacgcacagagagagtgacagtgtcaactgggtttggaaaggtgggctttccagatgaagagatgagaaaggccattccaggcacaggcatgcagtcgggtggaaatgcgtctgagaggtaggtggtggggaggatcaggcagggaaagccatggactttggatttatctgaagctgaatcaggtgaagggcagtcatctcagggtttaaagccaggcagcagtaggatgcggatgcgcactgcattttagccaggccaccctggcagcagggaggagaggcaagaagggcctagaaatcagagggtcttaggggactgtggcggtagtcccttcttctactgaacccagcctgctctgtcctcaggtattgcactatgtggagaaacccagcacatttatcagtgacatcatcaactgcggcatctacctcttttctcctgaagccttgaagcctcttcgggatgtcttccagcgtaatcagcaggatgggcaattgtgaggcaggccccatagccctgtgaccccaagtacccccagtcacggaccccaacacataccagtctctgcaggctccatctcaacttgc

SEQ ID NO: 291489 - DNA, 208 bp, Homo sapiens
cagatatttatcttaagagaggctggtgtcatgaaaaaagctatggactaagaatgggaagacaaagatcttttgtattggcactaccagctgtgtccctctgagggggtaatttttgccttttgaagatgttgggagggttaaagttcaggaaattatttttaaaactgtttcagtgaatatttagaaaaatattagtggagataga

SEQ ID NO: 291490 - DNA, 911 bp, Homo sapiens
gtcccgagtgtctgtcccaggcccccgccccacaggatcccggcccgggagcccccgatgcagggacccgcccgggactctgggtccccgcccatacctcaacttcgcacgactgcgtgcctcaagccgacgcagcggcctactctcgcactgcagacggggaaactgaggcctgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatggaggcagacatgcccgatgagatcaacattgatgaattgttggagttagagagtgaagaggagagaagccggaaaatccagggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataaaaacacaaaaaagagttttgaccacgagaccaaaagacaaaccaacaaaaacaacagccaacagacaacacacaa

SEQ ID NO: 291491 - DNA, 771 bp, Homo sapiens
tccttgaaagggcagaagccagctcctctcccgaatcccagaatctgacattccaggactccactaggcctgttttcctctgtgggaactagagccaaggcgagagacccgtgccagccccgaggctcccggggcccatgggcccgggcattcgggctggtacagggccccggggctctctcagcccatctgtcacccctcccccccaacacccagatgtcccgtcttggcagtgctgtcccggactgccacattaatgctccagaacccgccagctgggccctggggccggtggggctcctgcagagccctggacaaaggcgagggagggagggaaggggatcctaagcacccctccctccctggccctaggaggcagacatgcccgatgagatcaacattgatgaattgttggagttagagagtgaagaggagagaagccggaaaatccagggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataaaaacacaaaaaagagttttgaccacgagaccaaaagacaaaccaacaaaaacaacagccaacagacaacacacaa

SEQ ID NO: 291492 - DNA, 830 bp, Homo sapiens
gtcccgagtgtctgtcccaggcccccgccccacaggatcccggcccgggagcccccgatgcagggacccgcccgggactctgggtccccgcccatacctcaacttcgcacgactgcgtgcctcaagccgacgcagcggcctactctcgcactgcagacggggaaactgaggcctgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatgggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataaaaacacaaaaaagagttttgaccacgagaccaaaagacaaaccaacaaaaacaacagccaacagacaacacacaa

SEQ ID NO: 291493 - DNA, 876 bp, Homo sapiens
gtcccgagtgtctgtcccaggcccccgccccacaggatcccggcccgggagcccccgatgcagggacccgcccgggactctgggtccccgcccatacctcaacttcgcacgactgcgtgcctcaagccgacgcagcggcctactctcgcactgcagacggggaaactgaggcctgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatggaggcagacatgcccgatgagatcaacattgatgaattgttggagttagagagtgaagaggagagaagccggaaaatccagggactcctgaagtcatgtgggaaacctgtcgaggacttcatccaggagctgctggcaaagcttcaaggcctccacaggcagcccggcctccgccagccaagcccctcccacgactgctcacccctgaccctcttgcactctccctgccccccggacgccgcccagcttgcttgtgtataagttgtatttaatggttctgtaacaataaaaacacaaaaaagagttttgaccacgagaccaaaagacaaaccaacaaaaacaacagccaacagacaacacacaa

SEQ ID NO: 291494 - DNA, 907 bp, Homo sapiens
gtcccgagtgtctgtcccaggcccccgccccacaggatcccggcccgggagcccccgatgcagggacccgcccgggactctgggtccccgcccatacctcaacttcgcacgactgcgtgcctcaagccgacgcagcggcctactctcgcactgcagacggggaaactgaggcctgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatggaggcagacatgcccgatgagatcaacattgatgaattgttggagttagagagtgaagaggagagaagccggaaaatccagggactcctgaagtcatgtgggaaacctgtcgaggtgagttttctctccctcattctctccctgttctggccccaagtactctgatgggggagggggaagaagctggcagaagggtctctggggaacaccacccggccccaccacccccggccccaacctgccctccgcagctctttctggtctccaggggtgtcttttgtcctcctacttgtctctctccctctctcccccatctgctgagggggctccattctgtcctcccccatctgccctgtttttgcctctcctgtgcctgtcctttggccaccagcctt

SEQ ID NO: 291495 - DNA, 251 bp, Homo sapiens
attctaaatgtctgcggtcttgagactcatttcttcagcatcggctagactccagctcctcctcgcctctgttgctatcctgccttgtggccagctatcctgaacgtagcaataagagcacacgtgtgaaggggcccacctagtggaaggcctggccttgagctagaacttttccttttctttaattatggtttaaaaaaaatgcatgaggccgggcgcagtggctcacgcctgtaatcccagcactttgg

SEQ ID NO: 291496 - DNA, 3159 bp, Homo sapiens
  misc_feature (1445)..(1446): n is a, c, g, or t
  misc_feature (1481)..(1482): n is a, c, g, or t
  misc_feature (1614)..(1615): n is a, c, g, or t
  misc_feature (2878)..(2878): n is a, c, g, or t
  misc_feature (2927)..(2927): n is a, c, g, or t
  misc_feature (3111)..(3111): n is a, c, g, or t
tgctgccatgtgccgctgccacgggtacccagcctgtcgctaaactttccgggcgccagcccggctctgagtcgcgcttctcagcggagtgacccagggacggaggacccaggctggctggggactgtctgctcttctcggcgggatccgtggagagtcctttccctggaatccgagccctaaccgtctctccccagccctatccggcgaggagcggagcgctgccagcggaggcagcgccttcccgaagcagtttatctttggacggttttctttaaaggaaaaagcaaccaacaggttgccagccccggcgccacacacgagacgccggagggagaagccccggcccggattcctctgcctgtgtgcgtccctcgcgggctgctggaggcgaggggagggagggggcgatggctcggcctgacccatccgcgccgccctcgctgttgctgctgctcctggcgcagctggtgggccgggcggccgccgcgtccaaggccccggtgtgccaggaaatcacggtgcccatgtgccgcggcatcggctacaacctgacgcacatgcccaaccagttcaaccacgacacgcaggacgaggcgggcctggaggtgcaccagttctggccgctggtggagatccaatgctcgccggacctgcgcttcttcctatgctctatgtacacgcccatctgtctgcccgactaccacaagccgctgccgccctgccgctcggtgtgcgagcgcgccaaggccggctgctcgccgctgatgcgccagtacggcttcgcctggcccgagcgcatgagctgcgaccgcctcccggtgctgggccgcgacgccgaggtcctctgcatggattacaaccgcagcgaggccaccacggcgccccccaggcctttcccagccaagcccacccttccaggcccgccaggggcgccggcctcggggggcgaatgccccgctgggggcccgttcgtgtgcaagtgtcgcgagcccttcgtgcccattctgaaggagtcacacccgctctacaacaaggtgcggacgggccaggtgcccaactgcgcggtaccctgctaccagccgtccttcagtgccgacgagcgcacgttcgccaccttctggataggcctgtggtcggtgctgtgcttcatctccacgtccaccacagtggccaccttcctcatcgacatggacacgcttccgctatcctgagcgccccatcatcttcctgtcagcctgctacctgtgcgtgtcgctgggcttcctggtgcgtctggtcgtgggccatgccagcgtggcctgcagccgcgagcacaaccacatccactacgagaccacgggccctgcactgtgcaccatcgtcttcctcctggtctacttcttcggcatggccagctccatctggtgggtcatcctgtcgctcacctggttcctggccgccgnnatgaagtggggcaacgaggccatcgcgggctacgnncagtacttccacctggctgcgtggctcatccccagcgtcaagtccatcacggcactggcgctgagctccgtggacggggacccagtggccggcatctgctacgtgggcaaccagaacctgaactcgctgcgnngcttcgtgctgggcccgctggtgctctacctgctggtgggcacgctcttcctgctggcgggcttcgtgtcgctcttccgcatccgcagcgtcatcaagcagggcggcaccaagacggacaagctggagaagctcatgatccgcatcggcatcttcacgctgctctacacggtccccgccagcattgtggtggcctgctacctgtacgagcagcactaccgcgagagctgggaggcggcgctcacctgcgcctgcccgggccacgacaccggccagccgcgcgccaagcccgagtactgggtgctcatgctcaagtacttcatgtgcctggtggtgggcatcacgtcgggcgtctggatctggtcgggcaagacggtggagtcgtggcggcgtttcaccagccgctgctgctgccgcccgcggcgcggccacaagagcgggggcgccatggccgcaggggactaccccgaggcgagcgccgcgctcacaggcaggaccgggccgccgggccccgccgccacctaccacaagcaggtgtccctgtcgcacgtgtaggaggctgccgccgagggactcggccggagagctgaggggaggggggcgttttgtttggtagttttgccaaggtcacttccgtttaccttcatggtgctgttgccccctcccgcggcgacttggagagagggaagaggggcgttttcgaggaagaacctgtcccaggtcttctccaaggggcccagctcacgtgtattctattttgcgtttcttactgccttctttatgggaaccctctttttaatttatatgtatttttcttaatttgtaactttgttgcattttggcaacaatttacctttgctttgggggctttacaatcctaaggttggcgttgtaatgaagttccacttggttcaggtttctttgaactgtgtggtctcaattgggaaaatatatttcctatacgtgtgtctttaaaaaaaaatgtgaacagtgaacgtttcggttgctgtgactgggaagttgttgggtgtgctttttcagccagcttctccttccactgcttaaagtgtccatgattctttaaggtgagctgcagtttatagccccaggtcatacctaggaggggagcataatgagctcagggcctccccaaagtgacaaggttagggagtgcttagcggttttgtgttcagccttagctttgtttatagagggaggttcagtttcttttctgtagtgcttgtaataattctcactcctaacngcaccatcgttgtgtcttgaataagttagaggtagcattatagaggatntggcataaatatttgcagtagtgagagcctaagcgatggtgattggtggagcttgaattttaggctggtgagatggcagcttttgtgcctgagaggtagtgggtggttcttaagcttcagtgatcccttttttttttttttttttttttttttaaggaacttgtgttataatttggtaaaagtntaaacccactccctctggacaatacttagcgacagttgctaaaggggc

SEQ ID NO: 291497 - DNA, 811 bp, Homo sapiens
atgccagtagcacccccattctacctccaagtgtgacaaccagaaatttttccagccaatgccaaatgttttctggggcacaaaaatcaccaccggttgagaaccactggttatatgattagacggaaagaaaaagagaaaaagaaagatgcctggctaggccaattagagatcttagataattactatatgcatgcaacattagatagttttattttcattaaacttttaaatcttttaaaatctcttacagaccctactttgaagctagcttgatataatgctaatgtgaccttgaacgatttctttcttcctgagtttgcctactagtatagcttaaagatccaagttacactattactcacttatatcatagccagcattgcttgatcagattatcagatagatacagtatcacggagacaaaatcctttcattatgatgtaagataaaaaatatctttcattaacaacacacgtaaaggaagtacccactggaccaactcaggttagaagggtaccagaccagaagatcagatcgtagaagttactggagaaaaagatcagcggacagcactcttgaactacatgccaggcctcttcttcctggaactctaatggatttaaatggcttaagagacgggatgaattgttgaaaatggttctttcaaaagacctcacggaaggccaaagacaagactcactgaggccaagctgatcaacaatatctataagttgacgcattctaatcatgtggcgatcttgaccttgggagcttgatttgtggaccagtgtccccaagaagatgacca

SEQ ID NO: 291498 - DNA, 436 bp, Homo sapiens
gcggcatattaaaagaatatacaccaccagcaagtgggatctcttcctggaatgcaaggatagttcaacatatgaaatcaatcaatgtaacacagcacattaacagaatgaaggggaaaaaaacacataaaacacgtatcatctcaactgacacagaaaaagcatctgacaaaattcagcaccccatgacaaaaacactcaagaagctaggcgtggtggctcatgcctgtaaccctagcactttgggaggccgaggtgggtggatcacgagatcaggagatcgagaccatcctgactaacacagtgaaaccccatctctactaaaaatataaaataattagccgggcgtggtggcaggcacctgtagtcccagctgctcgggaggctgaggcaggagaatggtgtgaacctcgaggcggagcttgcagggagccgc

SEQ ID NO: 291499 - DNA, 337 bp, Homo sapiens
agaatgaaggggaaaaaaacacataaaacacgtatcatctcaactgacacagaaaaagcatctgacaaaattcagcaccccatgacaaaaacactcaagaagctaggcgtggtggctcatgcctgtaaccctagcactttgggaggccgaggtgggcgaattgcttgggctcagaagtttgagaccagtctgggcagtatggtaaaaccctgtctctacacaacggccatgtgtggtggctctcatctgcaatcccagctacttgggaggatcacttgaggccagaagtttgagtccagcctggacgacacagcaagaccttgtttctaaatatata

SEQ ID NO: 291500 - DNA, 177 bp, Homo sapiens
atgtgtctccataacgttattttacaggtgcgtatctgaaatctgaaatttgggagaacattctactagtgttctctagtgagaaaatacagctggaaggaagaagggagggaagatgaaggagagagaaacagaatgcatttgagagaaaatgctatgtagactaaaatagaatac

SEQ ID NO: 291501 - DNA, 758 bp, Homo sapiens
gagtagttctcctgggtccgctctgcgggcttctgggagatgtagtttctggtctgtaggcaggacggaaggagcgggggaggccccttacgcaaactacaattcccggcggggagcgcggtgaagcgggggtgggatctgaacatggcggcggtggtagctgctacggcgctgaagggccggggggcgagaaatgcccgcgtcctccgggggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctgggccatcggcttcccttgtggtatcctcctcttcatcctcaccaagcgggaagtggacaaggaccgtgtgaagcagatgaaggctcggcagaacatgcggttgtccaacacgggcgagtatgagagccagaggttcagggcttcctcccagagtgccccgtcccctgatgttgggtctggggtgcagacctgaggagcgctgcgaccctcctaggctattgactgttaagtcctcaggtttggcccagattccagttcgtgcctctgaggtccaccagagggcgcatgaagcccaggctgttgccaaaccctaccctgccccacaccaaggagccagccaaaggcaaataaagttattgagtgtttagtagaaaggaa

SEQ ID NO: 291502 - DNA, 148 bp, Homo sapiens
gcggccgcctactactactactgctcgaattcaagcttctaacgatgtacggcgcatgaagcccaggctgttgccaaaccctaccctgccccacaccaaggagccagccaaaggcaaataaagttattgagtgtttagtagaaaggaa

SEQ ID NO: 291503 - DNA, 715 bp, Homo sapiens
gagtagttctcctgggtccgctctgcgggcttctgggagatgtagtttctggtctgtaggcaggacggaaggagcgggggaggccccttacgcaaactacaattcccggcggggagcgcggtgaagcgggggtgggatctgaacatggcggcggtggtagctgctacggcgctgaagggccggggggcgagaaatgcccgcgtcctccggggacccgggccctgcaaagccacagctccccagagggcaaggaggaacctgaacccctatccccggagctggaatacattcccagaaagaggggcaagaaccccatgaaagctgtgggactggcctgggccatcggcttcccttgtggtatcctcctcttcatcctcaccaagcgggaagtggacaaggaccgtgtgaagcagatgaaggctcggcagaacatgcggttgtccaacacgggcgagtatgagagccagaggttcagggcttcctcccagagtgccccgtcccctgatgttgggtctggggtgcagacctgaggagcgctgcgaccctcctaggctattgactgttaagtcctcaggtttggcccagattccagttcgtgcctctgaggtccaccagagggcgcatgaagcccaggctgttgccaaaccctaccctgccccacaccaaggagccagccaaaggcaaataaagttattgagtgtttagtagaaaggaa

SEQ ID NO: 291504 - DNA, 883 bp, Homo sapiens
gagtagttctcctgggtccgctctgcgggcttctgggagatgtagtttctggtctgtaggcaggacggaaggagcgggggaggccccttacgcaaactacaattcccggcggggagcgcggtgaagcgggggtgggatctgaacatggcggcggtggtagctgctacggcgctgaagggccggggggcgagaaatgcccgcgtcctccgggggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctgggccatcggcttcccttgtggtatcctcctcttcatcctcaccaagcgggaagtggacaaggaccgtgtgaagcagatgaaggctcggcagaacatgcggttgtccaacacgggcgagtatgagagccagaggttcagggcttcctcccagagtgccccgtcccctgatgttgggtctggggtgcagacctgaggagcgctgcgaccctcctaggctattgactgttaagtcctcaggtttggcccagattccagttcgtgcctctgaggtccaccagagggcgcatgaagcccaggctgttgccaaaccctaccctgccccacaccaaggagccagccaaaggcaaataaagttattgagtgtttagtagaaaggaaaacaaaaaacaaaaaaaaaaagggggggccgccgggggccccaaggagcccggagccgggggccaaaagccgggggggcagcggggccccccgggcgggaattggcacttgttttcccaccaagg

SEQ ID NO: 291505 - DNA, 485 bp, Homo sapiens
tcatctggactgccctagggccggggtcgcagctccacgaccggcctgtgggtcaggtggcgcatgcgcgagcacggccccgcggcaccatgacaacctcgtcgtcgctgggtgtctcgctatccccacagcctccccctcgtgccgaattcggcacgagtggacaaggaccgtgtgaagcagatgaaggctcggcagaacatgcggttgtccaacacgggcgagtatgagagccagaggttcagggcttcctcccagagtgccccgtcccctgatgttgggtctggggtgcagacctgaggagcgctgcgaccctcctaggctattgactgttaagtcctcaggtttggcccagattccagttcgtgcctctgaggtccaccagagggcgcatgaagcccaggctgttgccaaaccctaccctgccccacaccaaggagccagccaaaggcaaataaagttattgagtgtttagtagaaaggaa

SEQ ID NO: 291506 - DNA, 355 bp, Homo sapiens
aggtgatctacagcgatcttattccggttctgggtagccacagctccccagagggcaaggaggaacctgaacccctatccccggagctggaatacattcccagaaagaggggcaagaaccccatgaaagctgtgggactggcctgggccatcggcttcccttgtggtatcctcctcttcatcctcaccaagcgggaagtggacaaggaccgtgtgaagcagatgaaggctcggcagaacatgcggttgtccaacacgggcgagtatgagagccagctaacaaggcttctcataacaggacccgggccctgcaaagccacagctccccagagggcaaggaggaacctgaaccccta

SEQ ID NO: 291507 - DNA, 1536 bp, Homo sapiens
gagtagttctcctgggtccgctctgcgggcttctgggagatgtagtttctggtctgtaggcaggacggaaggagcgggggaggccccttacgcaaactacaattcccggcggggagcgcggtgaagcgggggtgggatctgaacatggcggcggtggtagctgctacggcgctgaagggccggggggcgagaaatgcccgcgtcctccggggtaaggagagggaccccggggagggcaggactgcagaagatcccttttctttcacgtccagcccgacgatagcaggaggtcagggctcttggttcctccccacacttttctgcaagatcttagagtctgggggtgcagagatgctctttagaggtcacccagtgcatccccccgccttcgggttgctcgacacctccggggtcttgctgcaagagggagctcctaggaagcctgttggactcccgcgctccaggtgtttcacactcaccgcagtgcagaggaaagagccccgggcttctggaggtttgagttccagccccggataattagcagtttgaccttgggcaaagcagtttttctctcagggcttcagtttcctcttccgtacagtgcaagggatggagtagactatctttaaggtcccttccagtgctaacatttgcagtttcaaaaccttttcccggatttccttcatacgtcttatgtgagtcccactgcagtccttcccatgctgtcgtctgaggaagaacagcgaagcttttcgtcctggcaccagggtgatgagcccgcagtgacgtggaagtggcttccaaaggtgccacctcggtggcgattttcccatttccctttggattctccttggcacttcttacttcagactgcagtcactccccttccccagatctcagccgctcctcccaagcccttactgccccccacctccccgcttgctttcttctcatctcttcttactgaccttccttacctccatccacagggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctgggccatcggcttcccttgtggtatcctcctcttcatcctcaccaagcgggaagtggacaaggaccgtgtgaagcagatgaaggctcggcagaacatgcggttgtccaacacgggcgagtatgagagccagaggttcagggcttcctcccagagtgccccgtcccctgatgttgggtctggggtgcagacctgaggagcgctgcgaccctcctaggctattgactgttaagtcctcaggtttggcccagattccagttcgtgcctctgaggtccaccagagggcgcatgaagcccaggctgttgccaaaccctaccctgccccacaccaaggagccagccaaaggcaaataaagttattgagtgtttagtagaaaggaa

SEQ ID NO: 291508 - DNA, 403 bp, Homo sapiens
actgatgaagctagaatgactccccccagctcctctggctcaggcttggcccctccccaaaccccgtgcacatctccccacccgtagggccatcggcttcccttgtggtatcctcctcttcatcctcaccaagcgggaagtggacaaggaccgtgtgaagcagatgaaggctcggcagaacatgcggttgtccaacacgggcgagtatgagagccagaggttcagggcttcctcccagagtgccccgtcccctgatgttgggtctggggtgcagacctgaggagcgctgcgaccctcctaggctattgactgttaagtcctcaggtttggcccagattccagttcgtgcctctgaggtccaccagagggcgcatgaagcccaggctgttgccaaaccctaccc

SEQ ID NO: 291509 - DNA, 595 bp, Homo sapiens
ccgcggacgcgtgggttttttttttcagagggggtctgtgtttattcacacactcctggtacagtgaggatggaggaacatttacgaagggcacccctgggttgagaacatctccggggccacagatgtcatccaaaggttcagagcagtccccatttgggttcccaggggcaagacgcaggggtccaaggtaaaatcggatctgggcccttggaaggtgatgataccttggggagaaggggtctgccagaaagcctcctggggtcaggcctgggcagactggccatgtggttggtaaccgtgtcgggggcttgtctcatcccagcctcaacacccatcctatctgccaggcgcagaagagcgtggccgagactgaggggagggcaggaaccatgagcagagccagtaaacaaagagtcggatataaaaatacaaatgtgctgaggaagtcccttagaaagaggctgaggctggggtcacgccagacaggggtgggggcgaggaacggcccggaggactgggctcaagtgggtggaaagctcatgcaagtacgcagccaaacatccctggccgcgcgcggtccgacaccggcggc

SEQ ID NO: 291510 - DNA, 1572 bp, Homo sapiens
caccaggctaagcgcccgatccgagtagccagtcttcatttactccactaaaatgtaatttttctgcatttgtctcctctgatgcactccacgctccataggagcagggacaatgtcttactcctcagtttatacccagccctgggtacacaggcgctaatttagaacgaatgtccagaaaagcaacattcctgcctacctcccccacaaccgctgaagccagcattctccttcgcctgcgctgggaacatctgtgttcatgctgtctctccaggagggcaaagcccctgttcgcgcccctcctgcctgcccttcgagccttccggatgctgagaaaaatgaacctttcactaattttcagatttcctgataaaagtcattcatattgaaaatatgagaggacgcagtgatgagcccacgtgagtctgacaccttgagtgcggccctaggaaatgacttggcagtacagccggaggattcagggtctggacgatagttttcccagccggaggattcttcgaagagcgcttagtaaaggacggaagttccacgtgtttgtgttgagcaactgcaggtggtgggcggagacaccagcgccccgccttctgcatcctgccttccgtattggctgaagggccggcggctctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggtgggtaatcccggcgcggccccgccaggtagagctggcaggaccggcgccgcatgggcttggcctggtccgctttcctcccgcctgtctatccctcttggaggacgcctgcgttgggacgcgagatccagctccttcagagtcccggctgtatttagtcaaggctaacaggagtaagagattgttggtcccggggccctctggagaaagacagtccctcagagtttgagcgttgggggtacccaagaccctgtccggaccctcgggaggcaggcagccttggggaccggattgctcagaggaccgagatcaagtcctagcgctaattgacttgtaaaacttaggacaagtcatgaacccgttctgagctttagattcagttctagaaatggtactgcgagttcacatcggaggcggcacgcgcaggcacctcgagaataatgcccagcgcttttctttttgcccctgggcactgggagccagagtcacctagagagagtcctgtctgaaacttggtcctatgccttagagagtgagaacagcaccctctaggggtggaggggagattgccgcccagggtgatacgattccccaaagggagacgtgctggaggaaaggtagggctctggggtgttcggctgacctcttgaggttctctcctagtgtcagccttggaggcgctagtaaagtttgaatgagcaacagatt

SEQ ID NO: 291511 - DNA, 369 bp, Homo sapiens
ctagtatttaaacaacttgtcccagcccacacagctaggagtgatagagccagggtttgcacccaggcctgtgcgattccaaggcttgtgctttttctgcactctgccacctcctctcagtactagagggtttggattgagagaaaacggggccaagagtggatggatattcagggggaggtgagaaccaaaactaacgtagctcttttgctacccattccctcccaccctcctcaggtagttggaattcctgacttaggacttggggttgggtccaaggtgcttacatcccaggggcctcatgcctaagatagagggtgggagcgaacccacatgaaccaatacagcccagctccaactagatccaga

SEQ ID NO: 291512 - DNA, 2645 bp, Homo sapiens
caccaggctaagcgcccgatccgagtagccagtcttcatttactccactaaaatgtaatttttctgcatttgtctcctctgatgcactccacgctccataggagcagggacaatgtcttactcctcagtttatacccagccctgggtacacaggcgctaatttagaacgaatgtccagaaaagcaacattcctgcctacctcccccacaaccgctgaagccagcattctccttcgcctgcgctgggaacatctgtgttcatgctgtctctccaggagggcaaagcccctgttcgcgcccctcctgcctgcccttcgagccttccggatgctgagaaaaatgaacctttcactaattttcagatttcctgataaaagtcattcatattgaaaatatgagaggacgcagtgatgagcccacgtgagtctgacaccttgagtgcggccctaggaaatgacttggcagtacagccggaggattcagggtctggacgatagttttcccagccggaggattcttcgaagagcgcttagtaaaggacggaagttccacgtgtttgtgttgagcaactgcaggtggtgggcggagacaccagcgccccgccttctgcatcctgccttccgtattggctgaagggccggcggctctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctcccacctcaccttgcttccttcaggactcagatcatgaggacttccttagtgccattcagctctgaggccagagcatggtcctccacccttcctgccattctgccctgggctcctcaggtagttggaattcctgacttaggacttggggttgggtccaaggtgcttacatcccaggggcctcatgcctaagatagagggtgggagcgaacccacatgaaccaatacagcccagctccaactagatccagattccaggtttcttgcttctttcttgggttcctcagttctctcctgggttccccaacctcctctgccaccacaccaaaccaccagtgatgcatcccctggggcaaagctcatcataacccctctgcacaccagccagcctggagaccgttgttcctggggcctgttactgatcctcatctagccttgatttatccacaggagactgcaggctttgaacctagattgctttatgtttctcaccctagctccatccccaacactggtgaccagtcacgcctgggttgtatctctacccaaggaggccacatcataatgaggttcccaggccagcctggcctgtctgtcttacttggcaaccgtccctcaccagcaacatgcacctgagattcccaagtacctgccccccctcccattttggcctggctcctgagacctaagcagcggccacacacacacagagggggtctgtgtttattcacacactcctggtacagtgaggatggaggaacatttacgaagggcacccctgggttgagaacatctccggggccacagatgtcatccaaaggttcagagcagtccccatttgggttcccaggggcaagacgcaggggtccaaggtaaaatcggatctgggcccttggaaggtgatgataccttggggagaaggggtctgccagaaagcctcctggggtcaggcctgggcagactggccatgtggttggtaaccgtgtcgggggcttgtctcatcccagcctcaacacccatcctatctgccaggcgcagaagagcgtggccgagactgaggggagggcaggaaccatgagcagagccagtaaacaaagagtcggatataaaaatacaaatgtgctgaggaagtcccttagaaagaggctgaggctggggtcacgccagacaggggtgggggcgaggaacggcccggaggactgggctcaagtgggtggaaagctcatgcaagtacgcagccaaacatccctggccgcgcgcggtccgacaccggcggc

SEQ ID NO: 291513 - DNA, 2716 bp, Homo sapiens
  misc_feature (710)..(710): n is a, c, g, or t
  misc_feature (780)..(780): n is a, c, g, or t
caccaggctaagcgcccgatccgagtagccagtcttcatttactccactaaaatgtaatttttctgcatttgtctcctctgatgcactccacgctccataggagcagggacaatgtcttactcctcagtttatacccagccctgggtacacaggcgctaatttagaacgaatgtccagaaaagcaacattcctgcctacctcccccacaaccgctgaagccagcattctccttcgcctgcgctgggaacatctgtgttcatgctgtctctccaggagggcaaagcccctgttcgcgcccctcctgcctgcccttcgagccttccggatgctgagaaaaatgaacctttcactaattttcagatttcctgataaaagtcattcatattgaaaatatgagaggacgcagtgatgagcccacgtgagtctgacaccttgagtgcggccctaggaaatgacttggcagtacagccggaggattcagggtctggacgatagttttcccagccggaggattcttcgaagagcgcttagtaaaggacggaagttccacgtgtttgtgttgagcaactgcaggtggtgggcggagacaccagcgccccgccttctgcatcctgccttccgtattggctgaagggccggcggctctggctgcccggcggttgagagcatggcctctccaggggcaggtagggcggcctttcccggtggnaaagggctttttttaaacccccggggggggcaaaaggccccgggggggaacatcctgggccggggggggntttaaccccgggccgtaaagtcgaggtaccttggggaatcaagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctcccacctcaccttgcttccttcaggactcagatcatgaggacttccttagtgccattcagctctgaggccagagcatggtcctccacccttcctgccattctgccctgggctcctcaggtagttggaattcctgacttaggacttggggttgggtccaaggtgcttacatcccaggggcctcatgcctaagatagagggtgggagcgaacccacatgaaccaatacagcccagctccaactagatccagattccaggtttcttgcttctttcttgggttcctcagttctctcctgggttccccaacctcctctgccaccacaccaaaccaccagtgatgcatcccctggggcaaagctcatcataacccctctgcacaccagccagcctggagaccgttgttcctggggcctgttactgatcctcatctagccttgatttatccacaggagactgcaggctttgaacctagattgctttatgtttctcaccctagctccatccccaacactggtgaccagtcacgcctgggttgtatctctacccaaggaggccacatcataatgaggttcccaggccagcctggcctgtctgtcttacttggcaaccgtccctcaccagcaacatgcacctgagattcccaagtacctgccccccctcccattttggcctggctcctgagacctaagcagcggccacacacacacagagggggtctgtgtttattcacacactcctggtacagtgaggatggaggaacatttacgaagggcacccctgggttgagaacatctccggggccacagatgtcatccaaaggttcagagcagtccccatttgggttcccaggggcaagacgcaggggtccaaggtaaaatcggatctgggcccttggaaggtgatgataccttggggagaaggggtctgccagaaagcctcctggggtcaggcctgggcagactggccatgtggttggtaaccgtgtcgggggcttgtctcatcccagcctcaacacccatcctatctgccaggcgcagaagagcgtggccgagactgaggggagggcaggaaccatgagcagagccagtaaacaaagagtcggatataaaaatacaaatgtgctgaggaagtcccttagaaagaggctgaggctggggtcacgccagacaggggtgggggcgaggaacggcccggaggactgggctcaagtgggtggaaagctcatgcaagtacgcagccaaacatccctggccgcgcgcggtccgacaccggcggc

SEQ ID NO: 291514 - DNA, 1620 bp, Homo sapiens
caccaggctaagcgcccgatccgagtagccagtcttcatttactccactaaaatgtaatttttctgcatttgtctcctctgatgcactccacgctccataggagcagggacaatgtcttactcctcagtttatacccagccctgggtacacaggcgctaatttagaacgaatgtccagaaaagcaacattcctgcctacctcccccacaaccgctgaagccagcattctccttcgcctgcgctgggaacatctgtgttcatgctgtctctccaggagggcaaagcccctgttcgcgcccctcctgcctgcccttcgagccttccggatgctgagaaaaatgaacctttcactaattttcagatttcctgataaaagtcattcatattgaaaatatgagaggacgcagtgatgagcccacgtgagtctgacaccttgagtgcggccctaggaaatgacttggcagtacagccggaggattcagggtctggacgatagttttcccagccggaggattcttcgaagagcgcttagtaaaggacggaagttccacgtgtttgtgttgagcaactgcaggtggtgggcggagacaccagcgccccgccttctgcatcctgccttccgtattggctgaagggccggcggctctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctcccacctcaccttgcttccttcaggactcagatcatgaggacttccttagtgccattcagctctgaggccagagcatggtcctccacccttcctgccattctgccctgggctcctcaggtagttggaattcctgacttaggacttggggttgggtccaaggtgcttacatcccaggggcctcatgcctaagatagagggtgggagcgaacccacatgaaccaatacagcccagctccaactagatccaga

SEQ ID NO: 291515 - DNA, 2655 bp, Homo sapiens
caccaggctaagcgcccgatccgagtagccagtcttcatttactccactaaaatgtaatttttctgcatttgtctcctctgatgcactccacgctccataggagcagggacaatgtcttactcctcagtttatacccagccctgggtacacaggcgctaatttagaacgaatgtccagaaaagcaacattcctgcctacctcccccacaaccgctgaagccagcattctccttcgcctgcgctgggaacatctgtgttcatgctgtctctccaggagggcaaagcccctgttcgcgcccctcctgcctgcccttcgagccttccggatgctgagaaaaatgaacctttcactaattttcagatttcctgataaaagtcattcatattgaaaatatgagaggacgcagtgatgagcccacgtgagtctgacaccttgagtgcggccctaggaaatgacttggcagtacagccggaggattcagggtctggacgatagttttcccagccggaggattcttcgaagagcgcttagtaaaggacggaagttccacgtgtttgtgttgagcaactgcaggtggtgggcggagacaccagcgccccgccttctgcatcctgccttccgtattggctgaagggccggcggctctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctcccacctcaccttgcttccttcaggactcagatcatgaggacttccttagtgccattcagctctgaggccagagcatggtcctccacccttcctgccattctgccctgggctcctcaggtagttggaattcctgacttaggacttggggttgggtccaaggtgcttacatcccaggggcctcatgcctaagatagagggtgggagcgaacccacatgaaccaatacagcccagctccaactagatccagattccaggtttcttgcttctttcttgggttcctcagttctctcctgggttccccaacctcctctgccaccacaccaaaccaccagtgatgcatcccctggggcaaagctcatcataacccctctgcacaccagccagcctggagaccgttgttcctggggcctgttactgatcctcatctagccttgatttatccacaggagactgcaggctttgaacctagattgctttatgtttctcaccctagctccatccccaacactggtgaccagtcacgcctgggttgtatctctacccaaggaggccacatcataatgaggttcccaggccagcctggcctgtctgtcttacttggcaaccgtccctcaccagcaacatgcacctgagattcccaagtacctgccccccctcccattttggcctggctcctgagacctaagcagcggccacacacacacagagggggtctgtgtttattcacacactcctggtacagtgaggatggaggaacatttacgaagggcacccctgggttgagaacatctccggggccacagatgtcatccaaaggttcagagcagtccccatttgggttcccaggggcaagacgcaggggtccaaggtaaaatcggatctgggcccttggaaggtgatgataccttggggagaaggggtctgccagaaagcctcctggggtcaggcctgggcagactggccatgtggttggtaaccgtgtcgggggcttgtctcatcccagcctcaacacccatcctatctgccaggcgcacccctcccctccccaatcctaccagatggctagttttccacaatgcagaggcagatgtgctatcagagtccgaacctctccataaagaagagataagaaattcggataaatagtctgatgttaatgtcacgccgtacatgaatgttggttacaacctgcccggaagtttcggctccagttggtgaatagctcaatctatgttcacaaccaaacaacacagaccgcgaacggtcaaacgccggcggccgca

SEQ ID NO: 291516 - DNA, 1357 bp, Homo sapiens
caccaggctaagcgcccgatccgagtagccagtcttcatttactccactaaaatgtaatttttctgcatttgtctcctctgatgcactccacgctccataggagcagggacaatgtcttactcctcagtttatacccagccctgggtacacaggcgctaatttagaacgaatgtccagaaaagcaacattcctgcctacctcccccacaaccgctgaagccagcattctccttcgcctgcgctgggaacatctgtgttcatgctgtctctccaggagggcaaagcccctgttcgcgcccctcctgcctgcccttcgagccttccggatgctgagaaaaatgaacctttcactaattttcagatttcctgataaaagtcattcatattgaaaatatgagaggacgcagtgatgagcccacgtgagtctgacaccttgagtgcggccctaggaaatgacttggcagtacagccggaggattcagggtctggacgatagttttcccagccggaggattcttcgaagagcgcttagtaaaggacggaagttccacgtgtttgtgttgagcaactgcaggtggtgggcggagacaccagcgccccgccttctgcatcctgccttccgtattggctgaagggccggcggctctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggtgggtaatcccggcgcggccccgccaggtagagctggcaggaccggcgccgcatgggcttggcctggtccgctttcctcccgcctgtctatccctcttggaggacgcctgcgttgggacgcgagatccagctccttcagagtcccggctgtatttagtcaaggctaacaggagtaagagattgttggtcccggggccctctggagaaagacagtccctcagagtttgagcgttgggggtacccaagaccctgggcactgggagccagagtcacctagagagagtcctgtctgaaacttggtcctatgccttagagagtgagaacagcaccctctaggggtggaggggagattgccgcccagggtgatacgattccccaaagggagacgtgctggaggaaaggtagggctctggggtgttcggctgacctcttgaggttctctcctagtgtcagccttggaggcgctagtaaagtttgaatgagcaacagatt

SEQ ID NO: 291517 - DNA, 497 bp, Homo sapiens
gatccctggaccgtgtcctctgaaggtgtccacactgtggaccaggtgttgagtgaggtgagggagcaacaagagaggaaagcagatcaataggtggggctgcggggttgaggtttcaggggactggaagaaatcagaagccagaagcatgttttggagcaagtagtgggtcgccctcaggagtgtggctctctgaagggagggaagggttaagcggggtcgagatttatagaggcggctggagtagtcaggctcacaaaggctgacatgtggttactgggttgccatagggatgaggtagcagccaggttcctgacaggtgacagagactgccaaggtgagcagttataggaaagtggtgcccctatacctgatatcactcctatacccttccctgaatagaatatagccctaatcccaaggaatggccaggggcagagaaagtggctcactctttgccatggaaagcctgagctacagatgtggggtggttcctg

SEQ ID NO: 291518 - DNA, 289 bp, Homo sapiens
aaaacaagaaagaactcttgaacccagctatgcatacaagaaaaataaattgtttgaagtgagacatgaggtaatcgagactcctcaatggggaaagtcagtgctcatctggcccctagtgtgcctgttgagctgaaatattttattgatgtgagtgcttaacaaatcaccaaatgctcagtgaatacctattatgtgtcatgagctctatgaggtagctttttttcatacagtcgtattttggcaaataaataaataatacgaggcataattgacagtgaaaatacca

SEQ ID NO: 291519 - DNA, 357 bp, Homo sapiens
ggttctatttgatgtctttactgtattataggacttacaaaaagaaaagaaaaagaatatatccaattaaaacaagaaagaactcttgaacccagctatgcatacaagaaaaataaattgtttgaagtgagacatgaggtaatcgagactcctcaatggggaaagtcagtgctcatctggcccctagtgtgcctgttgagctgaaatattttattgatgtgagtgcttaacaaatcaccaaatgctcagtgaatacctattatgtgtcatgagctctatgaggtagctttttttcatacagtcgtattttggcaaataaataaataatacgaggcataattgacagtgaaaatacca

SEQ ID NO: 291520 - DNA, 931 bp, Homo sapiens
aggttggcaaagaagagaaaagctccttgggaacttagttaccaggtcttatagcaccagctctgtgtcctcagagtcgctgtcatcaaggagacctctcactggtcaccgccgcagcccccacatggaccagtatgtgtccacagctcctccccgattccctatagcacagctgggaacatttaaacaagactctgcaggaatgggacggatattcaaggggaatttgctgcagaagaaagcacttaccacatttgaaaatgaacaccatattcgtttcttcacattgttggttcttttccatgtgatggtgttgctgaggaatcatagcaggatacaaggggtttctgaagactggaaaagggccaacagcatatttcgaaagtaaaaaactccttctttctcccactgtaggctttttgtgttttcaacatacccagcctcactcggaaaaataaaaataaaaataaagcacccactcacatgagcagccaagtttcagataccagtgggcacaagctcttccaaatgtctcctgttctggagatgttcacagtcctcacatcaaaactgaaacaagcaaacaaaaaaataaaaagcttactaccaaataccctaggaataagacttaaactctatttggaaattgaatttcttccatagtcaatcaatatttaataaagagagaaaaggagctcattacaaagaccatcttgtttctccacaagtcatctatgtgagattccagaatttcagggcgataagttcttaattgggaacattatatattctctttgcagccagtaagtacgcatcacttcacgagaaagcactgcggccaacatttctcctggtctgctctgggtttcagtgaagggcaggcctggaagcaccttgggaaatgaggtagagccaagctaaccctggagag

SEQ ID NO: 291521 - DNA, 5252 bp, Homo sapiens
gggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctca

SEQ ID NO: 291522 - DNA, 2385 bp, Homo sapiens
caaaaattagccgggcatggtggcaagcatctgtaaccccagctactcgggaggccgaggcagcagaattgcttgaacctgggaggcgggggttgcagtgagctgagattgcaccattgcactccagcctgggtgacagagtgaggttctgtctcaaaaacaaaacaaaactggtatttattctctgatcgttctggaggctccttctggagaatctaaggaagaatctgttcccgcctttctcctgggtggcgttgcaggtgctcgtttgcattccttggcttgtagacatgtcactcctgtctcccctctgctgtcacacatgttctactgtcatacaagttcttcctctgtatctctgtcttcacttggtgttctcctctctttgtgtatcttttctcctcctcttataaggacatcagtcatactggatgaacagcccattctactccaacatgacctcatcttaactaattacttctgcaaagactctatttccaaaaaaggtcacattctgaggtactggggggtagggtttcaacatgtccttttgtgggggggtcacaattcaacccacaacacaactcagcaacaaaaagacagccccattttaagacagacaatggatttcagtagattccaatggatttggatagatttcccaaggagagaaattggaaccctcgtacattgctggtgggaatataaaatggtgcggccactttggaaaacagcttggtagttcctcaagaagggaaacatagagttacacatgacccagcaagtctactcctaagtatatacccaagacaatgaaacatgtctacacaaaaacttgtgtataagtgatcatagcagcactattcataattgacaaaaagtagaaacaacccaaatgtccatcagccgaggagtggataagccaaatgtggtggatcgagacaatggaatattatttggcaataaaaaggaatgaacacttaaacatgcttatataacatggatgcacctggaaaacctcccactaagagaaagaagcaggcacaaaaggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggtgccgatttgctctgctgccacccccagcctgccagcctcactccacctcctgctggttcctgatttaggctccccacccttctgcctccccgcaaatgcccccatccttcccctagggatgaggccacagatcaggcttgccctacagcttctgctcctccccagccccggctggggccagtgccctgctcataggcagtgggccctgctcacccgtccctctcctgccacctcccactgatgggcggcaggctggctactcactgcgctgctcagggagtcccagcctgcttcattttcttcttgctctaccgtcctgttctttcagagcaggggcatggtttccttccaaatatttctgctgcttttataagtgtacacccttttttttaattataaaaatgggctcgtgcta

SEQ ID NO: 291523 - DNA, 1834 bp, Homo sapiens
agtgcatggagacgagaggtgtttctaaagatgggagaaatgacagcgtgcatgtgtgccgatgggagtcaccccatagagaaggaagaaagcagtgacagaggagaggactgctccttgtccttgagtagttggccaagggagagacctcctgcacaaatggagggtttggcctcacgcagaaagaagcacacttggttcatccctggcagcaggagggaaggcgtgggtgtagggaacagggcgtgtggaggggatcttttgggtgctcttattttctcagtgaaatacaggacgcaagagcagcagtggacggtgagaatggggatgttcccatccagctttcagggtcccatgtgatagtgccccgtggctggcctgtgttctggggacagtcactggccacatgcactgcagggcatcaggcagcagaggctgccttgggcaggacagagacaggcccgccaactaatgtgcccctttttgcctctgcctccaggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggtgccgatttgctctgctgccacccccagcctgccagcctcactccacctcctgctggttcctgatttaggctccccacccttctgcctccccgcaaatgcccccatccttcccctagggatgaggccacagatcaggcttgccctacagcttctgctcctccccagccccggctggggccagtgccctgctcataggcagtgggccctgctcacccgtccctctcctgccacctcccactgatgggcggcaggctggctactcactgcgctgctcagggagtcccagcctgcttcattttcttcttgctctaccgtcctgttctttcagagcaggggcatggtttccttccaaatatttctgctgcttttataagtgtacacccttttttttaattataaaaatgggctcgtgcta

SEQ ID NO: 291524 - DNA, 541 bp, Homo sapiens
  misc_feature (13)..(13): n is a, c, g, or t
  misc_feature (16)..(16): n is a, c, g, or t
  misc_feature (18)..(18): n is a, c, g, or t
  misc_feature (24)..(24): n is a, c, g, or t
caatcactcgttnatngnaacccnccagactactaaatgccaccttcagcccaaaagaagccttgtcagtctctaatcttcctttccatgcagattgccactgccttgtctcacgttcttctttcctgggtgacactggctttctatttgtcccccttatctcactctgtctttccttgagtccatcatctggtcaacatttactgagctgaagctccctggagcttactcactgagcctagtagagtgcggtctacattcccatggaggagataaacctgcgctagggactgtggtagctcagaggggcatgtacatcagacggaggcattctgggactgagtttggtacacctggggtctgatctccttatgcagaacatctaccctgcagtctgcatgactgtggtcaagtcacttttctaaacaaaaatctgtagcctacaggctcccagatgctagcctggagactgattcactaggttggggtcccagaacttgtatcctgctcaagttccccagggggttctggtgcacagctg

SEQ ID NO: 291525 - DNA, 5075 bp, Homo sapiens
cagtttacagcgtcagggcagtttacagcgtcagggtagtttacagcgtcagggctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctca

SEQ ID NO: 291526 - DNA, 5320 bp, Homo sapiens
gggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctcaaaaaaacaacaaaatcaacaaaaaacacagaaaacaacaagtgaaaaacaataagaacaccagggggg

SEQ ID NO: 291527 - DNA, 5598 bp, Homo sapiens
gggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctcaaaaaaaatacacatagaaaaagtaataaaaaacataaaagaggggggggccgtaaaaattttgcccgcccgagggccacatgtacaggtgaccccggttctggcaaaagggggccccagaaagcggcaaaataagcacgatccacgagcacgcataaaaaaggcggaagcgcagaaacagggtcaggggggaacattgtgggaagaagcagccatgttgcggggggggacaaattgtggagatccctacaagagattaggagccctaggggaaaatacaatgttaaggggataaggggaaaacaggggattatgggcgtgaaattgtgcagaggatgtagagattg

SEQ ID NO: 291528 - DNA, 4673 bp, Homo sapiens
gggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcaagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctca

SEQ ID NO: 291529 - DNA, 5004 bp, Homo sapiens
gggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccgacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctca

SEQ ID NO: 291530 - DNA, 4867 bp, Homo sapiens
gggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctca

SEQ ID NO: 291531 - DNA, 4207 bp, Homo sapiens
gggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagcttcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctca

SEQ ID NO: 291532 - DNA, 5195 bp, Homo sapiens
gggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctca

SEQ ID NO: 291533 - DNA, 4046 bp, Homo sapiens
agtgcatggagacgagaggtgtttctaaagatgggagaaatgacagcgtgcatgtgtgccgatgggagtcaccccatagagaaggaagaaagcagtgacagaggagaggactgctccttgtccttgagtagttggccaagggagagacctcctgcacaaatggagggtttggcctcacgcagaaagaagcacacttggttcatccctggcagcaggagggaaggcgtgggtgtagggaacagggcgtgtggaggggatcttttgggtgctcttattttctcagtgaaatacaggacgcaagagcagcagtggacggtgagaatggggatgttcccatccagctttcagggtcccatgtgatagtgccccgtggctggcctgtgttctggggacagtcactggccacatgcactgcagggcatcaggcagcagaggctgccttgggcaggacagagacaggcccgccaactaatgtgcccctttttgcctctgcctccaggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctca

SEQ ID NO: 291534 - DNA, 2855 bp, Homo sapiens
ttccttcagtggggggaaataggggctgggaggacaggaaagagtgggaaggatctgtgaggcccagagggagggggcgttatcagagcagtccctccctcatctcagcatgattggggagggggcagtgacccttgtcattagagggagagcgggtttgggagtcagataaactgggttcagagcttgactgtaccatttacaagctgggtgaccctagccaaatctcttcatctccttgagcctcagtttccccatctgtaaaatgaagatagcccctcaggtaagtgagcaggtcatgtggcacctggccaggcagtgctcactgaacagccattccttcccatccccaatgcctggtggtacccccagatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctca

SEQ ID NO: 291535 - DNA, 1937 bp, Homo sapiens
ttcccaaatctctcattgcggaacaggttaatattcctgcacgtcgtatgatgcgatggggggacggatcgcggaaggttgtccgggtgttggagtgtcccgtgtccctgcattggagatggcacttaggcaaatccgggtgcgtgattcaagggtgtggggcgagcgactttaggtcgcgaagcaattggaagtggttccaagaaaagcctctaagcttcagtcatacgagaccgtaccgcaaaccgacacaggtgggcgagatgagtattctaaggcgcaatgagagatttaaatctctcatgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctca

SEQ ID NO: 291536 - DNA, 3488 bp, Homo sapiens
gggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccctgaggagtctttgcaatgtattgaaggaattgctgccgtgtgagttttgaatgattttgcagtaaagacctgatctttctca

SEQ ID NO: 291537 - DNA, 2188 bp, Homo sapiens
gggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggtaggttaccaggagggtcccgggtgggtcccatctgcagggaccaggcctttcagaaggcagctgtgaagttctgttttccattgctaaaggggtagtgtgttcccacaagtgttataaaacctcattccagaatgccatcataatcatgttcattcagggaagcatttcaggaaaagtagtatattgtctcaaaactgcctacagaggacaaaaatactgtttcaccagtcaaataggaaaatattttccctgaaaactatgcaatttatgattatagaaaactcttgattccacctgtagctcagagcacatccggccccatgaagccccaggtgttttaaatggtccttccaaacgtgtttaccctcagtagttggtttatgtaacagctctgggtggcttgatcaaatctgctatttgttttgtttgtttgtttgttttgagatggagtctgggcaacaagagcgaaaccccacctca

SEQ ID NO: 291538 - DNA, 1677 bp, Homo sapiens
gggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccggtgagtggtgcaagccgttcagggggcagtcttgggaaatgtcagctgacacagggtttccccagctagtgaccctgagtggtctctgccttttccctgttagccttcctctccctgcatagtgatagtgttaatagcatcatgatgatggggctcatgtttcttggcatgtgagctgtagatataagcccggctgtttcttggcatgtgagctgtagatataagcccggcactgtgctgatc

SEQ ID NO: 291539 - DNA, 1767 bp, Homo sapiens
gggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaagtgagatttagctggagaggttttgctttgcggaggagcagcagactatgggacacttggcttttcctccccagctgttcaggaagccaacagaggtgccctgtgttctagcatagagagagggtgaggtaggggttgaaagtgtcttctagaaaggcttatctctagaccaagcttcccagccagtgtgccagcagatcttgagaccctcagcactcaggcaagagcctgtggctgctttgagactggtcacaaaaagcaggtgagactggccacctttagcaggaacagccttttttgccacactggggcagagttacatagttacaacagaggttgtgtggcctgcaaagcctgaagaatatactatctggccctttacagaagggctgaccctgccttggatttgctgaccctgccttagattattcaaacatccgaattgtaaatctttttttttttttttgggatggagtttcgctctgtcactcaggctggagtgcaatggcgcgatctcggttcactggcacctctgcttcccaggttcaagcaattctcctgcctcagcctcctgagtaactgggacaacaggcgcgcaccatcacgcccagctaatttttgtatttttagtagagaggggttttgctatgttggtcaggctgctctcaaactcctgaccttgtgatctgcctacctccgcctcccaaagtgctgggattatataaagagtggaatcaggaaaagcatatgaatattcaccctgagacacttatctctttggcccctaactgtctgggcttttgagcaagtagctggcactgtgcctctgaggactactaaatgccaccttcagcccaaaagaagccttgtcagtctctaatcttcctttccatgcagattgccactgccttgtctcacgttcttctttcctgggtgacactggctttctatttgtcccccttatctcactctgtctttccttgagtccatcatctggtcaacatttactgagctgaagctccctggagcttactcactgagcctagtagagtgcggtctacattcccatggaggagataaacctgcgctagggactgtggtagctcagaggggcatgtacatcagacggaggcattctgggactgagtttggtacacctggggtctgatctccttatgcagaacatctaccctgcagtctgcatgactgtggtcaagtcacttttctaaacaaaaatctgtagcctacaggctcccagatgctagcctggagactgattcactaggttggggtcccagaacttgtatcctgctcaagttccccagggggttctggtgcacagctg

SEQ ID NO: 291540 - DNA, 505 bp, Homo sapiens
gctctgtgccttctctggcctctattactgtgacatctgccaccaagacgatgcctcagtgattccggccaggatcatccacaactgggacctcaccaagcgcccggtaagtctcaagcccagcagcccagctgctgagggacagaggggtgttcactcctctttgctgctgctgttcatctgtttagaggagtttggctcctctaaacaagggaagccagggtcactggttcaggcactgtgatgttggggagctaaccaagagaaaagcttggtgcctgtccacagccttgggcagggctctatcggtggctgtcttggtccccaggaggaaagagtttgaggatggtttcttgcagctacaaacataactgcttaaggcaccagcagataaatgatagatagatagataaaatagatttgatagattagatagatggatggtggatggtcaggtaggtaggtggatgagcaggtggctaggtggatggttagggggctgggc

SEQ ID NO: 291541 - DNA, 340 bp, Homo sapiens
actgttcctagtgagcagggctctggccctgaggagtctttgcaatgtattgaaggaattgctgccgtgtgagttttgaatgattttgcagtaaagacctgatctttctcacactggtctggcttctgaattctaacactgccacggccaggggggagaccaccagccatctgttaccatctgtcagggtcccctaccctcatgttagtccctggcacgggggaaggcttgggaggtccgtggcaaacacttgtaggcagagggcttgcatgccaggagtgggcagggagaagagagtaagaaaaccaccttgccaagcccagcagtcaggctcttcctg

SEQ ID NO: 291542 - DNA, 324 bp, Homo sapiens
gctgcttactccaagagaatggctccaagagtccagaccattgcgaggagcccatgtcctgtgactcagacctgggcacagcaaatgctgaggactcagaccggtctctgcaagagtgagtacgctgcccccactccttcccatcttctctcttccctcctttctttcctctcctcctccctttcttcccatagcatgtgattgtctgttactgaactctattagtaattaaagaaagccaagggagtcatcgacttctccagggactggagtagctgggaactgtagcaggcaatacaggcatagtggagaaagtggacttag

SEQ ID NO: 291543 - DNA, 887 bp, Homo sapiens
acaaagaagggaaatgactacagaactcggaagtgaggtacagaaacagctggattggttacaggaaaaacaacgtaggagagtgacacagcagggatctcgctgataaaggacctgcatctgaatccagctcctccatccatgggccatgtgtcctggttgctgagacatctggagagccttgtacctcatcaaaagaagagagacagtaatccttgcctttctttcctcctaaggttgttaacgaggcttaaatgagagaacaaggatgaaagtattttgtaaactctaatgccctgtgtataaagcagagaataatagcatctgtggtgttagaaaatgcctggaactttgtaaagatgttgtttgattcaacattactggagtaaaccacaccattagacagaatgaaagactccaccgcagagagagagactgatttttataacaactgaatttattatagcataaactaaatacaaagctctgaataaataatcgtttttttcagtcatcacatctgcaggtgtgtatgtgaacatttccataagcacataaggatacagatgtcacagacatatttagtgagggaagcccagagtcacggttctctgtgggtaagagctagatgccttgagatgaacatacagggcaccgtctcaaatgatttggactatgtgactgtgttcgtttctccttcagactctgctcaagaaagtgtattgataacaggttgctccgccctcaagtttagggcactctcccacgctctttcatgcaaagttttttaacacctctctttaagaaaattcacaaatcagaagtattaccccagcttcaatctgacaatcaggacccctactctgcccctctttcctaggatctta

SEQ ID NO: 291544 - DNA, 2045 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291545 - DNA, 879 bp, Homo sapiens
gaggtctgggtggtgaatcggccgaggctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291546 - DNA, 930 bp, Homo sapiens
gaggtctgggtggtgaatcggccgaggctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctacaaaaaaaaaaaaaaaaaaaaaaaaaaaaaaccatacacacaaaaaaagggg

SEQ ID NO: 291547 - DNA, 929 bp, Homo sapiens
taggtacgaggctcggtgggtgaatcggccggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagaggacgagttatggggactctggctatgatgacgatgtctggggaaccggtgggctggagccggtttatgctccgacggtccgatttgagcgggggggtcttggtgcccggacagccgggaccaattctgggaaaattcaaaggtctaaaggccactgggcaatgatgctatcggggggtcccaagg

SEQ ID NO: 291548 - DNA, 778 bp, Homo sapiens
  misc_feature (38)..(38): n is a, c, g, or t
  misc_feature (40)..(40): n is a, c, g, or t
  misc_feature (706)..(707): n is a, c, g, or t
  misc_feature (710)..(710): n is a, c, g, or t
agcgagaggaacttaaggctaggtacgaggctgggtgntngggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggagtgcagagttgagctgctatggttgcaccnnctncgggtcagagttagaaggggcaggaagttgggcccgcctgaaacagtctgggaccgggggccgaccgt

SEQ ID NO: 291549 - DNA, 2910 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctacctctggttccctctcactgcccctgcttcccccatcacagcatggactactatgctaagggtaaggccaaattgcctgccattgccaattcagcatagacatggctttgttagtgtttcctttattataaagcactgaaataagttaaataaacaggtgggaggctgggcagtcccccagccggtttgtccacagcccctgggggcagtggaggtgaatacagggcccttctcactgagctcgtgaagtgcctcagtcaaggcaaggtcccctggtccatatgggcccccccgcccatggggttgggctggtccttatagtgcctacgttagtctgtgtggagcccctggccagcgggggagaaaaaggtggcttctggtccgtctgtataaaacatggggaagaaggacctagttcaggatgagtctgtgtggacagcccggctgccagcagtccccagggctggtgggccccgagagctcaaaacagagggtgggctatgaggtggggcccagccctcagaggcagagagaccaggccctcctgccccaccgtggccatgcaccttctggtggcgcttgtagttgtcccagtggcccgtggtataggcgcaggtggcacagcggaagggcttctcgcctgtgtgccgcagcatgtgacgtttgaggttcatgctctggttgcagctgtagttgcaaaggctacaccgaaaaggtttgtcaccagagtggatgcgaccatgacgcttgaggttggccagattgccacaggcataagggcagagggggcacttgtagggcttctctcctgtatggacgcgccatcgtgccgtttcaggttatccagatgagcagaggcataagga

SEQ ID NO: 291550 - DNA, 2096 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctacaaaaaaaaaaaaaaaaaaaaaaaaaaaaaaccatacacacaaaaaaagggg

SEQ ID NO: 291551 - DNA, 1967 bp, Homo sapiens
  misc_feature (38)..(38): n is a, c, g, or t
  misc_feature (40)..(40): n is a, c, g, or t
agcgagaggaacttaaggctaggtacgaggctgggtgntngggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291552 - DNA, 1948 bp, Homo sapiens
aaaaaaaaaaaaaaaaaaaaaaggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291553 - DNA, 1991 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagtccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291554 - DNA, 1843 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctgtttttttttttttttttttttttctttttagtgctgg

SEQ ID NO: 291555 - DNA, 1553 bp, Homo sapiens
  misc_feature (1544)..(1544): n is a, c, g, or t
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcaacctgatgccaccagggagtctatggtcaaactctcaagtaagctgagtgcgggagctngggaatggg

SEQ ID NO: 291556 - DNA, 1585 bp, Homo sapiens
  misc_feature (1576)..(1576): n is a, c, g, or t
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaaggtaggcagcaagtgtggactgagcagtgagcagatgctgcgccggcgggtggggggtactctgagacgctcagacagccagcaagcagtgaagtccccaccactgcttgagtcacctgatgccacccgggagtctatggtcaaactctcaagtaagctgagtgcgggagctngggaatggg

SEQ ID NO: 291557 - DNA, 1985 bp, Homo sapiens
  misc_feature (46)..(47): n is a, c, g, or t
tggcgttattatgtgacacctaatagaaaccgcgctgtggttttannaaaacagtgtcgtcgatcggataatggatagtgggatcgctgacagcgaggagagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291558 - DNA, 1879 bp, Homo sapiens
ccctatccggacaggtggctcttgccctttagactacagttcccagcatgcccaggcgattgcgtcccagaaccgacgtcccaccgccttcccacatcggatcgcagggctcccaaaatgcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291559 - DNA, 2418 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctggtgagtggttgcaggaaactaggttgactatattgaggactatggggagagacttaaaaacagctggttctgtggaagggcctgatttaatttctagatctaggaaggctcttgtttgatctgttatgcagttagcaaagtaaatagtgtacgaggatgtgtaactctgtgtactagcaaaacaatttgggcactaacatctatgagaaatactagtataacactagtcttaatatcagtggagagaacttaatttgtatctgatgtgctttagattaacatcattgttatttccctagttctatagactggactcacctagatggcagccaagggtggggcaggtgaagaatttatgcaaacagtgagtgagttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291560 - DNA, 1683 bp, Homo sapiens
  misc_feature (39)..(40): n is a, c, g, or t
cgactttagaggaacccctccttgaatccaagcagtcgnnagaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291561 - DNA, 1974 bp, Homo sapiens
  misc_feature (38)..(38): n is a, c, g, or t
  misc_feature (40)..(40): n is a, c, g, or t
agcgagaggaacttaaggctaggtacgaggctgggtgntngggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcaggtgggactagcacccctgccttgagacagcttcaagcccttccctacacgtggacatcagtgtctccctttacccgctcttcttgttcccgtaggctgtagttcccctttaatcactgccacaggttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291562 - DNA, 1210 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgttctcagacggtaggatccgtagatcgacgca

SEQ ID NO: 291563 - DNA, 1890 bp, Homo sapiens
tgcctcagcctcccaagtagctagaattacaggcgcactgccaccatgtccggctaatttttgtatttttagtggagacggggttttgccgtgttggcctggctggtctcgaactcctgacctcaggtgatccacccgccttggcctcccaaagtgctgggattacgggtgtgagccaccacacccagccaggccatgtcatcttaataacagaggagtcatcttttttaatggaatggaacttctattcttatgaaatcaaagaaatcacagcctatatttaagcagctgagaataaagacacacaagggacctagaaatagagttgggcataggtcaaggcaagggacaaggcagtgcttcccatccccatgtgtgctcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291564 - DNA, 1704 bp, Homo sapiens
  misc_feature (38)..(38): n is a, c, g, or t
  misc_feature (40)..(40): n is a, c, g, or t
agcgagaggaacttaaggctaggtacgaggctgggtgntngggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291565 - DNA, 1515 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcagtgagttccagcgttggtgaggttgctgtttgttgggggatcttgcacgcccaagatctctgac

SEQ ID NO: 291566 - DNA, 1018 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagaggacgagttatggggactctggctatgatgacgatgtctggggaaccggtgggctggagccggtttatgctccgacggtccgatttgagcgggggggtcttggtgcccggacagccgggaccaattctgggaaaattcaaaggtctaaaggccactgggcaatgatgctatcggggggtcccaagg

SEQ ID NO: 291567 - DNA, 856 bp, Homo sapiens
  misc_feature (784)..(785): n is a, c, g, or t
  misc_feature (788)..(788): n is a, c, g, or t
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggagtgcagagttgagctgctatggttgcaccnnctncgggtcagagttagaaggggcaggaagttgggcccgcctgaaacagtctgggaccgggggccgaccgt

SEQ ID NO: 291568 - DNA, 483 bp, Homo sapiens
  misc_feature (39)..(40): n is a, c, g, or t
cgactttagaggaacccctccttgaatccaagcagtcgnnaggctgagacaaaaaaacattttcaaaacaaaacaaatctgggtgacggttagtgggggctcatcttcctattctctctctttttatacacacatgaacatttccaaaatacaatgtgaataattttttttttttgagacagcgactgcttggattacaaggagtcgaaagaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggagctctccattgtattgcagggat

SEQ ID NO: 291569 - DNA, 339 bp, Homo sapiens
ctagatgtgaggcttgtcttgagagggaggggaagtgatcctgccctcaccggcaccttgtgtctgtccccagatgctgcgccggcgggtggggggtactctgagacgctcagacagccagcaagcagtgaagtccccaccactgcttgtaagtattacctcctggtcagaaccctggctctcagccctgcctcacctctcctagtgagtttctgacacctctgcctcttcttccccaggagtcacctgatgccacccgggagtctatggtcaaactctcagtgagttccagcgttggtgaggttgctgtttgttgggggatcttgcacgcccaagatc

SEQ ID NO: 291570 - DNA, 582 bp, Homo sapiens
gggcacccaagagaacattatgagcatatgtagattgcctcatctcattttctgtgtttatgtgaagggttgtatctctttctctaaatagcttcggaaggagtatggggccaatgtgcttcctgcattccccccaaagaagcttttctctctgactcctgctgaggtagaacagaggagagagcagttagagaagtacatgcaagctggtgagtggttgcaggaaactaggttgactatattgaggactatggggagagacttaaaaacagctggttctgtggaagggcctgatttaatttctagatctaggaaggctcttgtttgatctgttatgcagttagcaaagtaaatagtgtacgaggatgtgtaactctgtgtactagcaaaacaatttgggcactaacatctatgagaaatactagtataacactagtcttaatatcagtggagagaacttaatttgtatctgatgtgctttagattaacatcattgttatttccctagttctatagactggactcacctagatggcagccaagggtggggcaggtgaagaatttatgcaaacagtgagtgag

SEQ ID NO: 291571 - DNA, 338 bp, Homo sapiens
tgaaatcaaagaaatcacagcctatatttaagcagctgagaataaagacacacaagggacctagaaatagagttgggcataggtcaaggcaagggacaaggcagtgcttcccatccccatgtgtgctcacaacaggagacacagcaggtccccacagaggaagtgtccttggaagtgctgctcagcaacgggcagaaagttctggtcaacgtgctaacttcagatcagactgaggatgtcctggaggtgaggcgcttgttcagcactgccccttcttcccctacatcctggggtcctgggcttggagaatgattggaaccagccagtatgatgagctg

SEQ ID NO: 291572 - DNA, 254 bp, Homo sapiens
aggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcatt

SEQ ID NO: 291573 - DNA, 1947 bp, Homo sapiens
tatttcattccgggctggtgctttagattgtattactgtgcccgtcgtgttcacaattaacgagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291574 - DNA, 2143 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctctggttccctctcactgcccctgcttcccccatcacagcatggactactatgctaagggtaaggccaaattgcctgccattgccaattcagcatagacatggctttgttagtgtttcctttattataaagcactgaaataagttaaataaacaggtgggaggctgggcagtcccccagccggtttgtccacagcccctgggggcagtggaggtgaatacagggcccttctcactgagctcgtgaagtgcctcagtcaaggcaaggtcccctggtccatatgggcccccccgcccatggggttgggctggtccttatagtgcctacgttagtctgtgtggagcccctggccagcgggggagaaaaaggtggcttctggtccgtctgtataaaacatggggaagaaggacctagttcaggatgagtctgtgtggacagcccggctgccagcagtccccagggctggtgggccccgagagctcaaaacagagggtgggctatgaggtggggcccagccctcagaggcagagagaccaggccctcctgccccaccgtggccatgcaccttctggtggcgcttgtagttgtcccagtggcccgtggtataggcgcaggtggcacagcggaagggcttctcgcctgtgtgccgcagcatgtgacgtttgaggttcatgctctggttgcagctgtagttgcaaaggctacaccgaaaaggtttgtcaccagagtggatgcgaccatgacgcttgaggttggccagattgccacaggcataagggcagagggggcacttgtagggcttctctcctgtatggacgcgccatcgtgccgtttcaggttatccagatgagcagaggcataagga

SEQ ID NO: 291575 - DNA, 2119 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttctatagactggactcacctagatggcagccaagggtggggcaggtgaagaatttatgcaaacagtgagtgagttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291576 - DNA, 1852 bp, Homo sapiens
  misc_feature (39)..(40): n is a, c, g, or t
cgactttagaggaacccctccttgaatccaagcagtcgnnaggctgagacaaaaaaacattttcaaaacaaaacaaatctgggtgacggttagtgggggctcatcttcctattctctctctttttatacacacatgaacatttccaaaatacaatgtgaataattttttttttttgagacagcgactgcttggattacaaggagtcgaaagaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291577 - DNA, 1927 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291578 - DNA, 1923 bp, Homo sapiens
  misc_feature (38)..(38): n is a, c, g, or t
  misc_feature (40)..(40): n is a, c, g, or t
agcgagaggaacttaaggctaggtacgaggctgggtgntngggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagttctatagactggactcacctagatggcagccaagggtggggcaggtgaagaatttatgcaaacagtgagtgagttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291579 - DNA, 1055 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagcctggcgcttgcgctactggaaatgctcacgggtttcctacagagacacag

SEQ ID NO: 291580 - DNA, 765 bp, Homo sapiens
ccacttgaactaccgattcccgagctcggtacccctagtcagacacgctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctac

SEQ ID NO: 291581 - DNA, 1183 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagaggttgggacctgactagatgaggagtcatgagcacggggtggcggcaaaagaaaaggagaaggataacacattgaccccgctgcgctagacaccacagcccaccccgcaagaccacttacagcaacccccagaagagagcaggaaaggacaacaagaggccaaaggagacgagcgagagcagcggtagacggacaagcaaagacgcgtgccgacaccagaacgaaaaacagaccaggagtctgaacaaaagaaccaggacacaacactgagcaacgcaacaagaaaaccacagggcgaggacacccagccagacgacacacgacagacgcgacaacaccacactggaacat

SEQ ID NO: 291582 - DNA, 1508 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccgctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctacctctggttccctctcactgcccctgcttcccccatcacagcatggactactatgctaagggtaaggccaaattgcctgccattgccaattcagcatagacatggctttgttagtgtttcctttattataaagcactgaaataagttaaataaacaggtgggaggctgggcagtcccccagccggtttgtccacagcccctgggggcagtggaggtgaatacagggcccttctcactgagctcgtgaagtgcctcagtcaaggcaaggtcccctggtccatatgggcccccccgcccatggggttgggctggtccttatagtgcctacgttagtctgtgtggagcccctggccagcgggggagaaaaaggtggcttctggtccgtctgtataaaacatggggaagaaggacctagttcaggatgagtctgtgtggacagcccggctgccagcagtccccagggctggtgggccccgagagctcaaaacagagggtgggctatgaggtggggcccagccctcagaggcagagagaccaggccctcctgccccaccgtggccatgcaccttctggtggcgcttgtagttgtcccagtggcccgtggtataggcgcaggtggcacagcggaagggcttctcgcctgtgtgccgcagcatgtgacgtttgaggttcatgctctggttgcagctgtagttgcaaaggctacaccgaaaaggtttgtcaccagagtggatgcgaccatgacgcttgaggttggccagattgccacaggcataagggcagagggggcacttgtagggcttctctcctgtatggacgcgccatcgtgccgtttcaggttatccagatgagcagaggcataagga

SEQ ID NO: 291583 - DNA, 561 bp, Homo sapiens
accagatgaccatggaatgcggctgtcttttctttggaaaagagggagtgtctgatgaagcactaaggagagcttctgtaagggaaaggcccctcaggacagtcaggggcagaggctctgttacaaggtcctgctcccggagccacagctatgcagttggaggcatcacgctcatataggaatgtgtgcggtcatactgaacacatgtgcaaagccacaaaaacaaggatgtccagtgagggaccaacacattggccgggaacaactcagacacccagcagtctggagcaggttggactggtccggccattctatgcagtactgagctaccccaaagcgggtgcatccacgaagacacaccggattcagttgttaggttaaatgagatgcacgtgtccggaaggaacccaggaaactcttggtcattccctctggagtaccagggtaaaacacatgtgcaagaactttgtcaatagctggggggagggggcgtcacacacgaccctctggtgacagtgagcaaagcctgggctgtgtgctctcctgccctgcacaccctga

SEQ ID NO: 291584 - DNA, 496 bp, Homo sapiens
cttctgagctggaaaggtccaagaaacataggctattgataatgggattttgaatttagtttgtggagggcaattcagtatcaatattctttgaccaaggaatttgtctgctaggaatgtgtgcggtcatactgaacacatgtgcaaagccacaaaaacaaggatgtccagtgagggaccaacacattggccgggaacaactcagacacccagcagtctggagcaggttggactggtccggccattctatgcagtactgagctaccccaaagcgggtgcatccacgaagacacaccggattcagttgttaggttaaatgagatgcacgtgtccggaaggaacccaggaaactcttggtcattccctctggagtaccagggtaaaacacatgtgcaagaactttgtcaatagctggggggagggggcgtcacacacgaccctctggtgacagtgagcaaagcctgggctgtgtgctctcctgccctgcacaccctga

SEQ ID NO: 291585 - DNA, 666 bp, Homo sapiens
gtttccccctgagggaagtatacctgtcctgccagccttggtctctggcagggaaggtccttccaacagagagggaattgcttagaattgactcaacactgcctccttgctgaatggataattcaagcaaacaactcaagagctggatgctgcccagacaggtaggcagccagataaagtgagtgtccagggaaagagcagtaagggtcagaagagaaagagcctggtgttctcactgcctcctgccttccttatgactgtctgttcagaagtcctcctagcatctttcttctgccttcccctgctcctgtccctgaaaccttttcttcaaaagaagtggaaaagaggaactgggaacccatatagcaacagcatcacctggaatgaattcctttagaacatactgtcttggaaatctgaagcctgcagggctggacaggcaagaagagcagtgagcactgcatgaacctgcatgtactccgaaatatttttcaaatggaaaagaaaacagagaacacaattttcaaaatatctagagccctccaagaagtctttgtagagatctataaaatctcaaggcaatttaaagaatagaaaaatgttttagaaacactattctctccacatcctggggcagcagccttctccaaagaaacagaaagaagg

SEQ ID NO: 291586 - DNA, 663 bp, Homo sapiens
ctgggggagaaggaagcctatatattatgtaggatccaagtctcaaactgctttcctagggagtgtgaggttcttggagattaagtgcagtacctttctgtcttgagccttgtaggctgcccctctaatttaatgccagtcttgaaataaacagaatgctttccaagtcatcgctaattttaacactttaaatttagaattgcttagaattgactcaacactgcctccttgctgaatggataattcaagcaaacaactcaagagctggatgctgcccagacaggtaggcagccagataaagtgagtgtccagggaaagagcagtaagggtcagaagagaaagagcctggtgttctcactgcctcctgccttccttatgactgtctgttcagaagtcctcctagcatctttcttctgccttcccctgctcctgtccctgaaaccttttcttcaaaagaagtggaaaagaggaactgggaacccatatagcaacagcatcacctggaatgaattcctttagaacatactgtcttggaaatctgaagcctgcagggctggacaggcaagaagagcagtgagcactgcatgaacctgtaagtaaatctgcatgtggatggtgttttgggtttttttcagacagagccttactctgttgcataggctg

SEQ ID NO: 291587 - DNA, 2116 bp, Homo sapiens
tggctaggagaggcgggggttaatcggacgatgctcagactacaggtgtgagccaccatgcccggccttctcctttaagtattgttggcctcactttcccaactaaaatgggagctcactaagaacaaaggctgttccttcatcttatacttagtaccttgaaagggcctaccacacagtaggtggtcacgtgttagtctgttaggtcttttggattttctaggtagacaatcacatcgattgcaaataatagtctttctcttttcagtctttgtatttcttttttcttgttttattgcattgactgagctcatcagtgaaatgttgaatagtagcaatgatggagggcaccccaatcttattatgctcaatactcattaatttatgcaataggaatgtaaagtacctactgcaggtcaaatcctgtgcctggggataacagtgtaacacatttgagatcttttcctgtccactgaaatgcctgagcagtagcagtatttcagtaaacacgacaatgctgagaatatcaccaaattctccagacttgctgaagtgttcctttgggatcctggttcccaaaaagtatggacataggtccctgctggtggccccaggttccaggccatcagtaaggttgggggctgcagactggaccactgcaccgtggagcagaggtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaactctctcttttccctgga

SEQ ID NO: 291588 - DNA, 1605 bp, Homo sapiens
ctctgaggctcccagtcgcagcggtgaccgcgggcgggtggggcgccgggtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaactctctcttttccctgga

SEQ ID NO: 291589 - DNA, 1605 bp, Homo sapiens
cgagttggcccggagcaaggcggcccaggacaggcaggggctgcacgcggtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaactctctcttttccctgga

SEQ ID NO: 291590 - DNA, 1823 bp, Homo sapiens
cttgtcccacgctttctaggatgggaaccaaggtgacatctgtacacatattgagttgatgatctcagctcactgactgcaacctccaccccagattcaagcaattttcctgtctcagcctcccaagtagcaggatttacagagaacgctgcctacctcaccccaacggcatttgaaagtagactggctcatctgaaatgcttatttgcaagcatctaacttcctgaccctgtgtcacagatggccccacttggccccaagcccctggtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaactctctcttttccctgga

SEQ ID NO: 291591 - DNA, 1727 bp, Homo sapiens
accaagggaagttctgagggctgagaggttgctcattcgtcagagcgtgctgcccaccctccacccctgcatggcagaaactgtgcaggggacgaggccaaggaatcaggagacccagaggcaggggtggcccggagacggtgggatggagcagaagctccccgaaaggggttggcggggtggattcgccccgctccagccggcggaggaagtgaagaaaccaagacgcagagaggccaagccccttgccttgggtcacacagccaaaggaggcagagccagaactcacaaccaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaactctctcttttccctgga

SEQ ID NO: 291592 - DNA, 1565 bp, Homo sapiens
ctctgaggctcccagtcgcagcggtgaccgcgggcgggtggggcgccgggtgaagaaaccaagacgcagagaggccaagccccttgccttgggtcacacagccaaaggaggcagagccagaactcacaaccaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaactctctcttttccctgga

SEQ ID NO: 291593 - DNA, 1489 bp, Homo sapiens
tgtgggctctgagtggccaactgcctgaagctcttgctctctgtccccgccttctaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaactctctcttttccctgga

SEQ ID NO: 291594 - DNA, 1821 bp, Homo sapiens
  misc_feature (1755)..(1755): n is a, c, g, or t
ctctgaggctcccagtcgcagcggtgaccgcgggcgggtggggcgccgggtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaactctctcttttccctggaaaaaaaaaaaaaaaaaaaaaaaaaagaaaaaaaaaaaaaaaaaaaaaaaaaaaaaaaaaaaaaaaaaaacaaaaaaaaaataaaaagagaaggagcgagccaacgacgaacataaataactgaccatcgagaaccaccaccacctaatgnccactcccccttacactatctcaaatagacacaacgcacacaaaagaagagaagaaaataaacagg

SEQ ID NO: 291595 - DNA, 1653 bp, Homo sapiens
accaagggaagttctgagggctgagaggttgctcattcgtcagagcgtgctgcccaccctccacccctgcatggcagaaactgtgcaggggacgaggccaaggaatcaggagacccagaggcaggggtggcccggagacggtgggatggagcagaagctccccgaaaggggttggcggggtggattcgccccgctccagccggcggaggaagtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaactctctcttttccctgga

SEQ ID NO: 291596 - DNA, 1373 bp, Homo sapiens
cgagttggcccggagcaaggcggcccaggacaggcaggggctgcacgcggtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaactctctcttttccctgga

SEQ ID NO: 291597 - DNA, 587 bp, Homo sapiens
cagtttcatatatgcccctcttctgatccttcctcctgttggctgaatgcaaacaaaatgaatggagctggagaaattgtattgaactatgacatagaagccaaacaccaaggatgacaaagcaaggagctacaaataatctggattcctgacatcatagacctccattctggccttattcatctacctggatttttatgcttggagtcttctgtgaacccattgcgtggatgcatcacaagaacaccattagtggtcaagccatccatctgtccatctgatgtcttccatttggcagccttctcctagtagaaataatagcagtgagcttccaacttgtaacttgtaacttggaatgaaagctagtataaaagaaagcatcatttagaaaaaaagctttttaccccaagaaagatgttttttgatgagtcaaatcctgcagcataaatccgtgctgtaaagggaggattccgttcacatatgattctgcaggcaaatcttgatatagtgctttgtactgactgtgtatcagaattactttgacttccaggaaccgtgtcagttactacaaaatcaatggggctttc

SEQ ID NO: 291598 - DNA, 1823 bp, Homo sapiens
cggcgggccccgcagcgccggacgctggttgcgcgctcccaggcgccgagcggccccgggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaactgcttcctttatatgtccaaaggtccgccccaacctaagggaagagaaaacagccctgagtttcctggaggaaattcccaagtcaatgtgctccctctttacaaggaaataggggcagagagagcaagttccagcctcaaagaaagaaggattaacggatagtgaatatgctgctacatctttcttacgaggcctgcccacccttacaaaggaactacatccttaacccacaggtagttttcagcgtggcagtagctcacactgtttcttgcggcagagggccctgggctcctcctggagactctaccaccagcggtagtgggccagggcacggttggcctctgccatcttgtgcaagtcatgcttcctcttgatcacggggccctggttatggaaagcctccagcagcttgtgtgacagcttctccggcatcagtgtccgctggtgctttttatcccggcactcagtgatcatccacttcatggctaggaagcggcgacgccg

SEQ ID NO: 291599 - DNA, 2615 bp, Homo sapiens
ccgcctctcccgcccgcgggaccctgggccgtgggctccgcagcccgccctgtgcctccgggaggggcgttccgggcgcggggggaacggccgagggctggagaccctaaaggcgcctcctacggccagaggggagcctccggcgggagccacctctccggggcgcatcatcctgccccccagtaagaggaaggctccagaatggagctcaggaattaggagtctcgagtgcgtagggccgggttactgccactcgggagccgatccgaccagcctgtcccagggagaagctggcacgggtctggggagttcaggctgctcccggcaggggcggcggacagggcgcctgcgtccccacccacgcaggccggccccatccgggggatgcagcggcgggtgttgagaccgaaggactcggcgaaagccagaaagagagggttggggagaggggctcggagacctgctggggacagagtcgcaccgcttggagttcccagcctggccctcacccggcatcttcctgggccagcaacgtcaggccggtttatttaagcaactgtaacgtccgcccgcacacaccctgccccagtctactcctgcctcctgctgggactggagggtgggcgctttcctgcttcagcttctcgctcttgtgtaatcccacaagcgagggatttctaaactgagcagcaggtgcctggctgatgcccagtccccaccagaagccaagcctggtgggccttcagccaaccaccgcacgccacggaccgcccaggagtccctgtcccgagcgcgccgtcagccccgtccagggcctgcaggacggaacccgccctgcgctccacacctgaggccgctcccttcgcctcttctcctcaggtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaactgcttcctttatatgtccaaaggtccgccccaacctaagggaagagaaaacagccctgagtttcctggaggaaattcccaagtcaatgtgctccctctttacaaggaaataggggcagagagagcaagttccagcctcaaagaaagaaggattaacggatagtgaatatgctgctacatctttcttacgaggcctgcccacccttacaaaggaactacatccttaacccacaggtagttttcagcgtggcagtagctcacactgtttcttgcggcagagggccctgggctcctcctggagactctaccaccagcggtagtgggccagggcacggttggcctctgccatcttgtgcaagtcatgcttcctcttgatcacggggccctggttatggaaagcctccagcagcttgtgtgacagcttctccggcatcagtgtccgctggtgctttttatcccggcactcagtgatcatccacttcatggctaggaagcggcgacgccg

SEQ ID NO: 291600 - DNA, 1918 bp, Homo sapiens
ccgcctctcccgcccgcgggaccctgggccgtgggctccgcagcccgccctgtgcctccgggaggggcgttccgggcgcggggggaacggccgagggctggagaccctaaaggcgcctcctacggccagaggggagcctccggcgggagccacctctccggggcgcatcatcctgccccccagtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaactgcttcctttatatgtccaaaggtccgccccaacctaagggaagagaaaacagccctgagtttcctggaggaaattcccaagtcaatgtgctccctctttacaaggaaataggggcagagagagcaagttccagcctcaaagaaagaaggattaacggatagtgaatatgctgctacatctttcttacgaggcctgcccacccttacaaaggaactacatccttaacccacaggtagttttcagcgtggcagtagctcacactgtttcttgcggcagagggccctgggctcctcctggagactctaccaccagcggtagtgggccagggcacggttggcctctgccatcttgtgcaagtcatgcttcctcttgatcacggggccctggttatggaaagcctccagcagcttgtgtgacagcttctccggcatcagtgtccgctggtgctttttatcccggcactcagtgatcatccacttcatggctaggaagcggcgacgccg

SEQ ID NO: 291601 - DNA, 2796 bp, Homo sapiens
ccgcctctcccgcccgcgggaccctgggccgtgggctccgcagcccgccctgtgcctccgggaggggcgttccgggcgcggggggaacggccgagggctggagaccctaaaggcgcctcctacggccagaggggagcctccggcgggagccacctctccggggcgcatcatcctgccccccagtaagaggaaggctccagaatggagctcaggaattaggagtctcgagtgcgtagggccgggttactgccactcgggagccgatccgaccagcctgtcccagggagaagctggcacgggtctggggagttcaggctgctcccggcaggggcggcggacagggcgcctgcgtccccacccacgcaggccggccccatccgggggatgcagcggcgggtgttgagaccgaaggactcggcgaaagccagaaagagagggttggggagaggggctcggagacctgctggggacagagtcgcaccgcttggagttcccagcctggccctcacccggcatcttcctgggccagcaacgtcaggccggtttatttaagcaactgtaacgtccgcccgcacacaccctgccccagtctactcctgcctcctgctgggactggagggtgggcgctttcctgcttcagcttctcgctcttgtgtaatcccacaagcgagggatttctaaactgagcagcaggtgcctggctgatgcccagtccccaccagaagccaagcctggtgggccttcagccaaccaccgcacgccacggaccgcccaggagtccctgtcccgagcgcgccgtcagccccgtccagggcctgcaggacggaacccgccctgcgctccacacctgaggccgctcccttcgcctcttctcctcaggtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggttgggggttgggagaggaaaggaagctgctttgaggaaggtgcttcaggagtgggcagaaggcctggcctgcaggacagagatgcacagggtctagctcaaagagagagagaggcataggatgggtggggttacaggggcaccgccccccacccttcaccttcctctccctggctcacaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaactgcttcctttatatgtccaaaggtccgccccaacctaagggaagagaaaacagccctgagtttcctggaggaaattcccaagtcaatgtgctccctctttacaaggaaataggggcagagagagcaagttccagcctcaaagaaagaaggattaacggatagtgaatatgctgctacatctttcttacgaggcctgcccacccttacaaaggaactacatccttaacccacaggtagttttcagcgtggcagtagctcacactgtttcttgcggcagagggccctgggctcctcctggagactctaccaccagcggtagtgggccagggcacggttggcctctgccatcttgtgcaagtcatgcttcctcttgatcacggggccctggttatggaaagcctccagcagcttgtgtgacagcttctccggcatcagtgtccgctggtgctttttatcccggcactcagtgatcatccacttcatggctaggaagcggcgacgccg

SEQ ID NO: 291602 - DNA, 1892 bp, Homo sapiens
cggcgggccccgcagcgccggacgctggttgcgcgctcccaggcgccgagcggccccgggcacgcgcgcgcgccaccggcccggcaggtgctgtccttattcccagcccagtcaagagctaccggggctggctagtcatgggggagcccagtagagaggagtataccccgtctcttgaatgcacagttgcctgctttgagacagaagatggagaatattccgtttgccagaggagctatagtaattgctctcgcctgatgccttcccgctgtaacacgcagtacagagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaactgcttcctttatatgtccaaaggtccgccccaacctaagggaagagaaaacagccctgagtttcctggaggaaattcccaagtcaatgtgctccctctttacaaggaaataggggcagagagagcaagttccagcctcaaagaaagaaggattaacggatagtgaatatgctgctacatctttcttacgaggcctgcccacccttacaaaggaactacatccttaacccacaggtagttttcagcgtggcagtagctcacactgtttcttgcggcagagggccctgggctcctcctggagactctaccaccagcggtagtgggccagggcacggttggcctctgccatcttgtgcaagtcatgcttcctcttgatcacggggccctggttatggaaagcctccagcagcttgtgtgacagcttctccggcatcagtgtccgctggtgctttttatcccggcactcagtgatcatccacttcatggctaggaagcggcgacgccg

SEQ ID NO: 291603 - DNA, 1318 bp, Homo sapiens
cggcgggccccgcagcgccggacgctggttgcgcgctcccaggcgccgagcggccccgggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaa

SEQ ID NO: 291604 - DNA, 2459 bp, Homo sapiens
ccgcctctcccgcccgcgggaccctgggccgtgggctccgcagcccgccctgtgcctccgggaggggcgttccgggcgcggggggaacggccgagggctggagaccctaaaggcgcctcctacggccagaggggagcctccggcgggagccacctctccggggcgcatcatcctgccccccagtaagaggaaggctccagaatggagctcaggaattaggagtctcgagtgcgtagggccgggttactgccactcgggagccgatccgaccagcctgtcccagggagaagctggcacgggtctggggagttcaggctgctcccggcaggggcggcggacagggcgcctgcgtccccacccacgcaggccggccccatccgggggatgcagcggcgggtgttgagaccgaaggactcggcgaaagccagaaagagagggttggggagaggggctcggagacctgctggggacagagtcgcaccgcttggagttcccagcctggccctcacccggcatcttcctgggccagcaacgtcaggccggtttatttaagcaactgtaacgtccgcccgcacacaccctgccccagtctactcctgcctcctgctgggactggagggtgggcgctttcctgcttcagcttctcgctcttgtgtaatcccacaagcgagggatttctaaactgagcagcaggtgcctggctgatgcccagtccccaccagaagccaagcctggtgggccttcagccaaccaccgcacgccacggaccgcccaggagtccctgtcccgagcgcgccgtcagccccgtccagggcctgcaggacggaacccgccctgcgctccacacctgaggccgctcccttcgcctcttctcctcaggtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaactgcttcctttatatgtccaaaggtccgccccaacctaagggaagagaaaacagccctgagtttcctggaggaaattcccaagtcaatgtgctccctctttacaaggaaataggggcagagagagcaagttccagcctcaaagaaagaaggattaacggatagtgaatatgctgctacatctttcttacgaggcctgcccacccttacaaaggaactacatccttaacccacaggtagttttcagcgtggcagtagctcacactgtttcttgcggcagagggccctgggctcctcctggagactctaccaccagcggtagtgggccagggcacggttggcctctgccatcttgtgcaagtcatgcttcctcttgatcacggggccctggttatggaaagcctccagcagcttgtgtgacagcttctccggcatcagtgtccgctggtgctttttatcccggcactcagtgatcatccacttcatggctaggaagcggcgacgccg

SEQ ID NO: 291605 - DNA, 1769 bp, Homo sapiens
cggcgggccccgcagcgccggacgctggttgcgcgctcccaggcgccgagcggccccgggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaactgcttcctttatatgtccaaaggtccgccccaacctaagggaagagaaaacagccctgagtttcctggaggaaattcccaagtcaatgtgctccctctttacaaggaaataggggcagagagagcaagttccagcctcaaagaaagaaggattaacggatagtgaatatgctgctacatctttcttacgaggcctgcccacccttacaaaggaactacatccttaacccacaggtagttttcagcgtggcagtagctcacactgtttcttgcggcagagggccctgggctcctcctggagactctaccaccagcggtagtgggccagggcacggttggcctctgccatcttgtgcaagtcatgcttcctcttgatcacggggccctggttatggaaagcctccagcagcttgtgtgacagcttctccggcatcagtgtccgctggtgctttttatcccggcactcagtgatcatccacttcatggctaggaagcggcgacgccg

SEQ ID NO: 291606 - DNA, 891 bp, Homo sapiens
gaattcaccaaagactttcttccagacttgagtgtccatctcctggtgagatgttcccacttatgcggactttcacaccacggcaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaactgcttcctttatatgtccaaaggtccgccccaacctaagggaagagaaaacagccctgagtttcctggaggaaattcccaagtcaatgtgctccctctttacaaggaaataggggcagagagagcaagttccagcctcaaagaaagaaggattaacggatagtgaatatgctgctacatctttcttacgaggcctgcccacccttacaaaggaactacatccttaacccacaggtagttttcagcgtggcagtagctcacactgtttcttgcggcagagggccctgggctcctcctggagactctaccaccagcggtagtgggccagggcacggttggcctctgccatcttgtgcaagtcatgcttcctcttgatcacggggccctggttatggaaagcctccagcagcttgtgtgacagcttctccggcatcagtgtccgctggtgctttttatcccggcactcagtgatcatccacttcatggctaggaagcggcgacgccg

SEQ ID NO: 291607 - DNA, 1492 bp, Homo sapiens
cggcgggccccgcagcgccggacgctggttgcgcgctcccaggcgccgagcggccccgggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaactgcttcctttatatgtccaaaggtccgccccaacctaagggaagagaaaacagccctgagtttcctggaggaaattcccaagtcaatgtgctccctctttacaaggaaataggggcagagagagcaagttccagcctcaaaggtcgacgcggccgcgaatttagtagtagtag

SEQ ID NO: 291608 - DNA, 1442 bp, Homo sapiens
cggcgggccccgcagcgccggacgctggttgcgcgctcccaggcgccgagcggccccgggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatggctcacacatccgcggtaaaattctacaaacctctcgcatcaaacaaaaaaacaccaggcgggccgcgccacaagcgcaaggggcataacacgcgcgcgaaccacaggcaggtgcaacaaggcaatcaccacggataaagcagcgctccacacctgtgtgacattacatatatagt

SEQ ID NO: 291609 - DNA, 400 bp, Homo sapiens
cctttgatgcagagacccagcagctgctgaagacagcactcaaaggtgagcacgggacccctcctgagctggggtcaggagctacagagaagggcccctgtgggcagcaccagaggctgagcctggtgaatgcctccacccctcccctcattctctgacgataggagtcggcaacgtaattcttgaactggaagacaagctacattgaggccattattttggagtatgaatcacagtcacctctcagactgtaaagactgttttaaaagtttaaccatagggctaggcgcagtggctcatgtctgtagttccagcactttggaaagccaaggtgggcagattgcttgagtccaggagttcaagaccagtcccggaaacatggtgtaaaccccatctctac

SEQ ID NO: 291610 - DNA, 562 bp, Homo sapiens
agtttatccaatagagagcagccaaaacctactggctcagtagcttccttctcagtcagaaagccaacgtatgatggcagctgtgcaagccatggctagctgtgggtacagacggccccaaagccaaaccagggtcaggcagtgtgtgggaggcaggagagtgggatgaagaagtggtttggagacaggcttgagtggagcctggccagatgagggacctcaggcaagtcccggaactcatttctttctgtgtaagatgtggaagtacccactggatggtaaggagggagcaagggaatgagtgtaaaggcaaagcacagcacctggcacttggcaaatgctgtgtgagaggctggcactgccccagttcacttgtgttacccacactgtcgcctgcaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttcc

SEQ ID NO: 291611 - DNA, 1946 bp, Homo sapiens
cggcgggccccgcagcgccggacgctggttgcgcgctcccaggcgccgagcggccccgggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagccccgtctcttgaatgcacagttgcctgctttgagacagaagatggagaatattccgtttgccagaggagctatagtaattgctctcgcctgatgccttcccgctgtaacacgcagtacagagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaactgcttcctttatatgtccaaaggtccgccccaacctaagggaagagaaaacagccctgagtttcctggaggaaattcccaagtcaatgtgctccctctttacaaggaaataggggcagagagagcaagttccagcctcaaagaaagaaggattaacggatagtgaatatgctgctacatctttcttacgaggcctgcccacccttacaaaggaactacatccttaacccacaggtagttttcagcgtggcagtagctcacactgtttcttgcggcagagggccctgggctcctcctggagactctaccaccagcggtagtgggccagggcacggttggcctctgccatcttgtgcaagtcatgcttcctcttgatcacggggccctggttatggaaagcctccagcagcttgtgtgacagcttctccggcatcagtgtccgctggtgctttttatcccggcactcagtgatcatccacttcatggctaggaagcggcgacgccg

SEQ ID NO: 291612 - DNA, 2717 bp, Homo sapiens
ccgcctctcccgcccgcgggaccctgggccgtgggctccgcagcccgccctgtgcctccgggaggggcgttccgggcgcggggggaacggccgagggctggagaccctaaaggcgcctcctacggccagaggggagcctccggcgggagccacctctccggggcgcatcatcctgccccccagtaagaggaaggctccagaatggagctcaggaattaggagtctcgagtgcgtagggccgggttactgccactcgggagccgatccgaccagcctgtcccagggagaagctggcacgggtctggggagttcaggctgctcccggcaggggcggcggacagggcgcctgcgtccccacccacgcaggccggccccatccgggggatgcagcggcgggtgttgagaccgaaggactcggcgaaagccagaaagagagggttggggagaggggctcggagacctgctggggacagagtcgcaccgcttggagttcccagcctggccctcacccggcatcttcctgggccagcaacgtcaggccggtttatttaagcaactgtaacgtccgcccgcacacaccctgccccagtctactcctgcctcctgctgggactggagggtgggcgctttcctgcttcagcttctcgctcttgtgtaatcccacaagcgagggatttctaaactgagcagcaggtgcctggctgatgcccagtccccaccagaagccaagcctggtgggccttcagccaaccaccgcacgccacggaccgcccaggagtccctgtcccgagcgcgccgtcagccccgtccagggcctgcaggacggaacccgccctgcgctccacacctgaggccgctcccttcgcctcttctcctcaggtgctgtccttattcccagcccagtcaagagctaccggggctggctagtcatgggggagcccagtagagaggagtataaaatccagtcctttgatgcagagacccagcagctgctgaagacagcactcaaagttgcctgctttgagacagaagatggagaatattccgtttgccagaggagctatagtaattgctctcgcctgatgccttcccgctgtaacacgcagtacagagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaactgcttcctttatatgtccaaaggtccgccccaacctaagggaagagaaaacagccctgagtttcctggaggaaattcccaagtcaatgtgctccctctttacaaggaaataggggcagagagagcaagttccagcctcaaagaaagaaggattaacggatagtgaatatgctgctacatctttcttacgaggcctgcccacccttacaaaggaactacatccttaacccacaggtagttttcagcgtggcagtagctcacactgtttcttgcggcagagggccctgggctcctcctggagactctaccaccagcggtagtgggccagggcacggttggcctctgccatcttgtgcaagtcatgcttcctcttgatcacggggccctggttatggaaagcctccagcagcttgtgtgacagcttctccggcatcagtgtccgctggtgctttttatcccggcactcagtgatcatccacttcatggctaggaagcggcgacgccg

SEQ ID NO: 291613 - DNA, 2919 bp, Homo sapiens
ccgcctctcccgcccgcgggaccctgggccgtgggctccgcagcccgccctgtgcctccgggaggggcgttccgggcgcggggggaacggccgagggctggagaccctaaaggcgcctcctacggccagaggggagcctccggcgggagccacctctccggggcgcatcatcctgccccccagtaagaggaaggctccagaatggagctcaggaattaggagtctcgagtgcgtagggccgggttactgccactcgggagccgatccgaccagcctgtcccagggagaagctggcacgggtctggggagttcaggctgctcccggcaggggcggcggacagggcgcctgcgtccccacccacgcaggccggccccatccgggggatgcagcggcgggtgttgagaccgaaggactcggcgaaagccagaaagagagggttggggagaggggctcggagacctgctggggacagagtcgcaccgcttggagttcccagcctggccctcacccggcatcttcctgggccagcaacgtcaggccggtttatttaagcaactgtaacgtccgcccgcacacaccctgccccagtctactcctgcctcctgctgggactggagggtgggcgctttcctgcttcagcttctcgctcttgtgtaatcccacaagcgagggatttctaaactgagcagcaggtgcctggctgatgcccagtccccaccagaagccaagcctggtgggccttcagccaaccaccgcacgccacggaccgcccaggagtccctgtcccgagcgcgccgtcagccccgtccagggcctgcaggacggaacccgccctgcgctccacacctgaggccgctcccttcgcctcttctcctcaggtgctgtccttattcccagcccagtcaagagctaccggggctggctagtcatgggggagcccagtagagaggagtataaaatccagtcctttgatgcagagacccagcagctgctgaagacagcactcaaagccccgtctcttgaatgcacagttgcctgctttgagacagaagatggagaatattccgtttgccagaggagctatagtaattgctctcgcctgatgccttcccgctgtaacacgcagtacagagatccgggtgctgtggacttggagaaagtggccaatgtgattgtggaccattctctgcaggactgtgtgttcagcaaggaagcaggacgcatgtgctacgccatcattcaggttgggggttgggagaggaaaggaagctgctttgaggaaggtgcttcaggagtgggcagaaggcctggcctgcaggacagagatgcacagggtctagctcaaagagagagagaggcataggatgggtggggttacaggggcaccgccccccacccttcaccttcctctccctggctcacaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaactgcttcctttatatgtccaaaggtccgccccaacctaagggaagagaaaacagccctgagtttcctggaggaaattcccaagtcaatgtgctccctctttacaaggaaataggggcagagagagcaagttccagcctcaaagaaagaaggattaacggatagtgaatatgctgctacatctttcttacgaggcctgcccacccttacaaaggaactacatccttaacccacaggtagttttcagcgtggcagtagctcacactgtttcttgcggcagagggccctgggctcctcctggagactctaccaccagcggtagtgggccagggcacggttggcctctgccatcttgtgcaagtcatgcttcctcttgatcacggggccctggttatggaaagcctccagcagcttgtgtgacagcttctccggcatcagtgtccgctggtgctttttatcccggcactcagtgatcatccacttcatggctaggaagcggcgacgccg

SEQ ID NO: 291614 - DNA, 1977 bp, Homo sapiens
gccatgatttcttataagtaccatgcgctaaccaattgcaccactggagccactgtcctctgtatgatttctgatctctttcacttcaagcatatgagtgctctactgtaaatatctcaaattcttagaagcgggtggacacaaatgtgataaagcagcagctctagactcccctcctatctctacccctagatccgggtgctgtggacttggagaaagtggccaatgtgattgtggaccattctctgcaggactgtgtgttcagcaaggaagcaggacgcatgtgctacgccatcattcaggttgggggttgggagaggaaaggaagctgctttgaggaaggtgcttcaggagtgggcagaaggcctggcctgcaggacagagatgcacagggtctagctcaaagagagagagaggcataggatgggtggggttacaggggcaccgccccccacccttcaccttcctctccctggctcacaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaactgcttcctttatatgtccaaaggtccgccccaacctaagggaagagaaaacagccctgagtttcctggaggaaattcccaagtcaatgtgctccctctttacaaggaaataggggcagagagagcaagttccagcctcaaagaaagaaggattaacggatagtgaatatgctgctacatctttcttacgaggcctgcccacccttacaaaggaactacatccttaacccacaggtagttttcagcgtggcagtagctcacactgtttcttgcggcagagggccctgggctcctcctggagactctaccaccagcggtagtgggccagggcacggttggcctctgccatcttgtgcaagtcatgcttcctcttgatcacggggccctggttatggaaagcctccagcagcttgtgtgacagcttctccggcatcagtgtccgctggtgctttttatcccggcactcagtgatcatccacttcatggctaggaagcggcgacgccg

SEQ ID NO: 291615 - DNA, 2508 bp, Homo sapiens
ccgcctctcccgcccgcgggaccctgggccgtgggctccgcagcccgccctgtgcctccgggaggggcgttccgggcgcggggggaacggccgagggctggagaccctaaaggcgcctcctacggccagaggggagcctccggcgggagccacctctccggggcgcatcatcctgccccccagtaagaggaaggctccagaatggagctcaggaattaggagtctcgagtgcgtagggccgggttactgccactcgggagccgatccgaccagcctgtcccagggagaagctggcacgggtctggggagttcaggctgctcccggcaggggcggcggacagggcgcctgcgtccccacccacgcaggccggccccatccgggggatgcagcggcgggtgttgagaccgaaggactcggcgaaagccagaaagagagggttggggagaggggctcggagacctgctggggacagagtcgcaccgcttggagttcccagcctggccctcacccggcatcttcctgggccagcaacgtcaggccggtttatttaagcaactgtaacgtccgcccgcacacaccctgccccagtctactcctgcctcctgctgggactggagggtgggcgctttcctgcttcagcttctcgctcttgtgtaatcccacaagcgagggatttctaaactgagcagcaggtgcctggctgatgcccagtccccaccagaagccaagcctggtgggccttcagccaaccaccgcacgccacggaccgcccaggagtccctgtcccgagcgcgccgtcagccccgtccagggcctgcaggacggaacccgccctgcgctccacacctgaggccgctcccttcgcctcttctcctcaggtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaactgcttcctttatatgtccaaaggtccgccccaacctaagggaagagaaaacagccctgagtttcctggaggaaattcccaagtcaatgtgctccctctttacaaggaaataggggcagagagagcaagttccagcctcaaagaaagaaggattaacggatagtgaatatgctgctacatctttcttacgaggcctgcccacccttacaaaggaactacatccttaacccacaggtagttttcagcgtggcagtagctcacactgtttcttgcggcagagggccctgggctcctcctggagactctaccaccagcggtagtgggccagggcacggttggcctctgccatcttgtgcaagtcatgcttcctcttgatcacggggccctggttatggaaagcctccagcagcttgtgtgacagcttctccggcatcagtgtccgctggtgctttttatcccggcactcagtgatcatccacttcatggctaggaagcggcgacgccg

SEQ ID NO: 291616 - DNA, 1836 bp, Homo sapiens
cggcgggccccgcagcgccggacgctggttgcgcgctcccaggcgccgagcggccccgggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaaaaaaaaaaaaaaaaaaaaaaaaaaaaaaaaaaaaaaaaaaaaaaaaaaaaaaaaaaagggggggggggcaaaaagaacccccgggggggcccccgacacacaccgcccacgacaagttttgagtagaaaaagagggccccaaaaaagaagcggaagacatgaataacaacgacaaaagaaggggcgcgatatataaaaaaaggtgacgaagggagaaaaaacaggcgaaaagcgagggaacaataggaaagaagagaacacaacaccagcgaggggaagcgtgagacaaaatatatgaggggaggacaaaacacaatacttcacacggaagaaaatctacacaaacaccgcattaggaggggaaaatatataaaaaatcattaaagagaagactattagagcggttgatacaacacaacagaccagcataaattatgtgtcgagggtggagaaagaaaaagattgtgctcacccaaccagaagaatgagtttagtagacgaagcaaaatattatgcgc

SEQ ID NO: 291617 - DNA, 3676 bp, Homo sapiens
cgcgcgcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaagatttgtgatcctaatccacctgggacagccccagatatgttcctaagaagaaaccagacttaagaataaaagaacacgtgtcaagagaaacctaagaatgacaaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctatgatagagcagctgagtcagctgataactgatcacctgcaaatacagcgctggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatcttgagaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtca

SEQ ID NO: 291618 - DNA, 993 bp, Homo sapiens
cgcgcgcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaattcacattgagaagtatttaaatgttgtaaaccagaatgtattaacgacttctgttaatgatgagagcttatatactccccaggcttccaaatggttacttccaactgtaattgatcagaaatcatttattttccctcaggaatctgagggtacattttggcaaccccaaagacagcacagttcatctctgcctgtctttccaagagcaaagcgaaagatagggttgaatgtaaaaatcttgcaggatcctgaaaacatccaccacagagctgctgtaaatgcgaactatggaatcagtttgccatatattaatcagagaaaagcatgttaggtcctcaaaggtatgtggaaacaagaagaaatccctggtactgttcatgttccctcactgacatccagttccagttagactttataatacaacacattaagaaatctacagaaaatttgactttgatttattccttttaaataaaaagtgtttcttaaaaggcttgaaacatgtatctgttaacatgaattttaaaagaacaattatgaatgcataacaaaatagccaaaccaaacattgctttgaattgctgcacaaataactgattataactgttatgacctagaaaaaaatcataaaaacatttttctttttggcaagatgtgagttgctgtagaattataccagttctttggttctactttccaaataaatatatatataatgca

SEQ ID NO: 291619 - DNA, 4239 bp, Homo sapiens
cgcgcgcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaattcacattgagaagtatttaaatgttgtaaaccagaatgtattaacgacttctgttaatgatgagagcttatatactccccaggcttccaaatggttacttccaactgtaattgatcagaaatcatttattttccctcaggaatctgagggtacattttggcaaccccaaagacagcacagttcatctctgcctgtctttccaagagcaaagataaaggtttcgaagttaatcaaagggtctaacatatccagcctcacggttctgccatcttctcattgcacagatccctatttcactcctataccagtcttacaagcagatgcccacaaagggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctaagcatcatatgtgcctggccactcacctgatgtacagtcccaaggcaatcaaaagaataaaaaatctcatccgaggaacagaggcctacatcgtcagcgggctcctccacagagatgatttagctgtggccgatatgttagacatacccatcctgggctctgagcctgaactagctcatctttatagtaccaaatctggaggcaaacgtgtctttgacagtgccaatgtggcagttcctcctggaatatatgatatttatagtcagcaacagatgatagagcagctgagtcagctgataactgatcacctgcaaatacagcgctggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatcttgaggaaaggcaaggaactgtttttatattatatgagcacctgaagagacacaagttgggaatgttaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtca

SEQ ID NO: 291620 - DNA, 3905 bp, Homo sapiens
cgcgcgcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctaagcatcatatgtgcctggccactcacctgatgtacagtcccaaggcaatcaaaagaataaaaaatctcatccgaggaacagaggcctacatcgtcagcgggctcctccacagagatgatttagctgtggccgatatgttagacatacccatcctgggctctgagcctgaactagctcatctttatagtaccaaatctggaggcaaacgtgtctttgacagtgccaatgtggcagttcctcctggaatatatgatatttatagtcagcaacagatgatagagcagctgagtcagctgataactgatcacctgcaaatacagcgctggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatcttgaggaaaggcaaggaactgtttttatattatatgagcacctgaagagacacaagttgggaatgttaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtca

SEQ ID NO: 291621 - DNA, 3776 bp, Homo sapiens
cgcgcgcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctaagcatcatatgtgcctggccactcacctgatgtacagtcccaaggcaatcaaaagaataaaaaatctcatccgaggaacagaggcctacatcgtcagcgggctcctccacagagatgatttagctgtggccgatatgttagacatacccatcctgggctctgagcctgaactagctcatctttatagtaccaaatctggaggcaaacgtgtctttgacagtgccaatgtggcagttcctcctggaatatatgatatttatagtcagcaacagatgatagagcagctgagtcagctgataactgatcacctgcaaatacagcgctggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatcttgaggaaaggcaaggaactgtttttatattatatgagcacctgaagagacacaagttgggaatgttaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtca

SEQ ID NO: 291622 - DNA, 2164 bp, Homo sapiens
ctccagtcttcaaggccatatctgctactctcctttagcacccatttgtagcactttaggtaggaaggaatatcacaaaatgcagtcccatttcctcggaactcagagtccattttaaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatcttgaggaaaggcaaggaactgtttttatattatatgagcacctgaagagacacaagttgggaatgttaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtca

SEQ ID NO: 291623 - DNA, 1458 bp, Homo sapiens
cgcgcgcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattaggtataacacttttgcctgcaaatctatcagcaacctctattacccaccacattatggctccttgattgagttcaaggaaggccccttgttttattcaaattggtctcggcaggaaaatgttctcgacatgatgagagtaataacacaggaccctcgcttgaaacggcgtttaatttggggattaagcaaataaagtcattatgtgggggctgctattcagtggagaggtgatttgctgtaattcgctttcatctgtatgaaatgaactaaaaagttgtatttttccccgaaataacagataatgttagagatacgggtgatga

SEQ ID NO: 291624 - DNA, 3229 bp, Homo sapiens
cgcgcgcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctaagcatcatatgtgcctggccactcacctgatgtacagtcccaaggcaatcaaaagaataaaaaatctcatccgaggaacagaggcctacatcgtcagcgggctcctccacagagatgatttagctgtggccgatatgttagacatacccatcctgggctctgagcctgaactagctcatctttatagtaccaaatctggaggcaaacgtgtctttgacagtgccaatgtggcagttcctcctggaatatatgatatttatagtcagcaacagatgatagagcagctgagtcagctgataactgatcacctgcaaatacagcgctggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatcttgaggaaaggcaaggaactgtttttatattatatgagcacctgaagagacacaagttgggaatgttaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacaatctctctaatccattcgaggggcccattgttcagacacttgacagataggaagtcctacatgcccattagagccgcgcctcgactgaagccagagcaacataaggtccaagagactcattagttcactggcacaatcgtgtcctgagagtaaatgaaaccctctgtctccttatggctctcatctgctctggactttaaaagaaaactgtctccgttttgttcggcacagtagtggatcattcacatggtgagagcccctgcttaacagtacaaaactgttaaatctatcggaaagttttgcatgtgaattttgattagcactcccgaagctcaagctgctggcaatagcgaaacgatttcgccatcct

SEQ ID NO: 291625 - DNA, 1330 bp, Homo sapiens
  misc_feature (44)..(44): n is a, c, g, or t
  misc_feature (47)..(47): n is a, c, g, or t
gaggaagaggagctgggagggaggtttaaacaaggcaacaagcnatngtaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtca

SEQ ID NO: 291626 - DNA, 1204 bp, Homo sapiens
cgcgcgcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaattcacattgagaagtatttaaatgttgtaaaccagaatgtattaacgacttctgttaatgatgagagcttatatactccccaggcttccaaatggttacttccaactgtaattgatcagaaatcatttattttccctcaggaatctgagggtacattttggcaaccccaaagacagcacagttcatctctgcctgtctttccaagagcaaagataaaggtttcgaagttaatcaaagggtctaacatatccagcctcacggttctgccatcttctcattgcacagatccctatttcactcctataccagtcttacaagcagatgcccacaaagggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaaggtctgtaatttgtgtgactagttgaaatttagggtctgtcacctgatgtcccttccttttgctgcagggcaagagtatgggtgactgcttgacagctggagatggcaacaaaagttcgtgcttcctttgtaaaagaaattagatcatggtttcaggaaaaaaaaaaaacatggttcatttaaagtgaaaacccttttttgcctccttttgggactgaattacttctcaggcttcagtccaaacaaatgacttagcgtccttaaaatttggctgaatcacatcaatcttcaaattcaatcaaagattttcatcttttaaaagtacacttaaaaagaaataaaatgtgaaaaataa

SEQ ID NO: 291627 - DNA, 493 bp, Homo sapiens
ctagtatagtttgggaaagaactccttgtgtgtgatcatgtttgtttgcttgtttttctcaaatcttgttgtcttatacctgagaaccacttcgaatctaaaagataaacatatacctagttccttcctgaaataccagaaattgcaagcttgtcaaattgtgattaatgaggatttactggatatcaacatatgagtcttcgatcaccaagaaagcaaagtgtattccatctgcatgacagtttaggctgtgaataccaagaatataatgttatgacctaagaaatctgaggatatcgtccttctgcctgctgaaaatcatggaattaaaaagatatagagtccattctgagaaattcaatttcatcaaatggaaagtgaaagcatctccaattctatatatacactgaagccttcatgccccatttacactacttgtatcgaatcccgtaataggtttctgcctattgagtccaaataaatggtggttatc

SEQ ID NO: 291628 - DNA, 612 bp, Homo sapiens
taggctgaggattacatttcacttggttacagctgactggggattttaatcatttggagccacactgaaaaaaaaatttccccctgcaatctactcttaactgatagtcgctaactttggttatgtgtggtaagtatttgacaatggtaagtatttttcaaaaacatttttcctttcttcttcacatgtaaatagattgctgctgatacctatactgtgtctgtattggttggaatgtccaaacaaactggaatagaatttaaaagtttttttgcggggtgttcatggtcactcatataattgtgctcctctggaagatagatttccccagaagtaagaaacaattcttctgcaattcttttctatgcttacctcacttgtcacattatgtgctttttttctattatggtactaatcagagtagagagcagtcctgtgctggaggaagaaatatatcattattgacttgtgtttccctaggggaagttggttgttataggaaaactgatggatgagcaacatttaatggcaaatgaggaaatgaattagcaaatggatgaattgttttacatgtcttctaaaatacatgtatacatgtagatacttgggaat

SEQ ID NO: 291629 - DNA, 1451 bp, Homo sapiens
taggctgaggattacatttcacttggttacagctgactggggattttaatcatttggagccacactgaaaaaaaaatttccccctgcaatctactcttaactgatagtcgctaactttggttatgtgtgtctattcagaatattacattaattgatttctcaaacaaaggtcctttctgaaatggtatctatgattcagctattcaaaacctaatgaagttggtgactatgacaatgtggagaaatcatgacagaaaatgtggtttgtactggggctgtcaatgctgtaaaggaagtttgggaaaaaagaataaagaaactcaatgaagacctgaagcgagagaaggaatttcaacacaagctagtgcggatctgggaagaacgagtaagcttaaccaagctaagagaaaaggtcaccagggaagatggaagagtcattttgaagatagaaaaagaggaatggaagaccctcccttcttctctgctgaaactgaatcaactacaggaatggcaacttcatagaactggtttgctgaaaattcctgaattcattggaagattccagaacctcatggtgttagatttatctcgaaacacaatttcagagataccaccagggattggactgcttactagacttcaggaactgattctcaggtacaacaaaatcaagactgtccccaaggaactaagtaattgtgccagcttggagaaactagaactggctgttaacagagatatatgtgatcttccacaagagctcagcaatctgctaaaacttactcaccttgatctgagtatgaacgattttactacaatccctcttgctgtgttgaacatgcctgcccttgagtggctggacatgggaagcaacaaacttgaacaacttcctgatactatagaaagaatgcaaaatctacatacgttatggctgcaacgaaatgaaataacatgcttgcctcaaacaatcagcaatatgaaaaatctgggtactcttgttctcagcaacaataaactgcaagatattccagtatgcatggaagaaatggcaaatctgaggtttgtcaacttcagagacaacccactgaaattgaaagtatcacttcctcccagtgaaggcacagatgaagaagaggaacgggaattatttggccttcagtttatgcacacatacatacaagagtcacggagaagagcagatcaccaagtcaacggttcaactactttaccaatctccataaatacggatggataatataattcaagatgcccttctaaagaggattactttggtgaattctctaatgtttggatttctgaagtaaaaagaaaagctattaccaaagtttaatgaggccacagcattttttaaagttcatattatttgctatttaaagtatatatttttttgatataaaaatataattaaaaaattttttttggtggaagac

SEQ ID NO: 291630 - DNA, 1226 bp, Homo sapiens
taggctgaggattacatttcacttggttacagctgactggggattttaatcatttggagccacactgaaaaaaaaatttccccctgcaatctactcttaactgatagtcgctaactttggttatgtgtgtctattcagaatattacattaattgatttctcaaacaaaggtcctttctgaaatggtatctatgattcagctattcaaaacctaatgaagttggtgactatgacaatgtggagaaatcatgacagaaaatgtggtttgtactggggctgtcaatgctgtaaaggaagtttgggaaaaaagaataaagaaactcaatgaagacctgaagcgagagaaggaatttcaacacaagctagtgcggatctgggaagaacgagtaagcttaaccaagctaagagaaaaggtcaccagggaagatggaagagtcattttgaagatagaaaaagaggaatggaagaccctcccttcttctctgctgaaactgaatcaactacaggaatggcaacttcatagaactggtttgctgaaaattcctgaattcattggaagattccagaacctcatggtgttagatttatctcgaaacacaatttcagagataccaccagggattggactgcttactagacttcaggaactgattctcaggtacaacaaaatcaagactgtccccaaggaactaagtaattgtgccagcttggagaaactagaactggctgttaacagagatatatgtgatcttccacaagaggttagaaagacataaatgcctatgattgtattttccatctgcagtagttgaccactcaatgtgtggttgttaacaataataaaactaatgagaaaattctatgtatttcagaaaaaatatttagagaaaaccatttccttaagtataatgcaggttttaactggagaaagatttagtgtaaaagatacttctattattatcacagtactgacatcatttgttaaactgtgatctccttgaaggccagggtgagagttgtattatagtctcagaattgagggcagagcctaggttgtagtgattacttaaatgctttttgaattaataaatggttatcataaagcacagacaatgtagtgatagcaatgggactggaatgcctccaaactttgatttggtatgatgtcttgttattggtcaaaccaaattgatcatataaaaataaagacatttgtattactttttg

SEQ ID NO: 291631 - DNA, 1411 bp, Homo sapiens
taggctgaggattacatttcacttggttacagctgactggggattttaatcatttggagccacactgaaaaaaaaatttccccctgcaatctactcttaactgatagtcgctaactttggttatgtgtggtcctttctgaaatggtatctatgattcagctattcaaaacctaatgaagttggtgactatgacaatgtggagaaatcatgacagaaaatgtggtttgtactggggctgtcaatgctgtaaaggaagtttgggaaaaaagaataaagaaactcaatgaagacctgaagcgagagaaggaatttcaacacaagctagtgcggatctgggaagaacgagtaagcttaaccaagctaagagaaaaggtcaccagggaagatggaagagtcattttgaagatagaaaaagaggaatggaagaccctcccttcttctctgctgaaactgaatcaactacaggaatggcaacttcatagaactggtttgctgaaaattcctgaattcattggaagattccagaacctcatggtgttagatttatctcgaaacacaatttcagagataccaccagggattggactgcttactagacttcaggaactgattctcaggtacaacaaaatcaagactgtccccaaggaactaagtaattgtgccagcttggagaaactagaactggctgttaacagagatatatgtgatcttccacaagagctcagcaatctgctaaaacttactcaccttgatctgagtatgaacgattttactacaatccctcttgctgtgttgaacatgcctgcccttgagtggctggacatgggaagcaacaaacttgaacaacttcctgatactatagaaagaatgcaaaatctacatacgttatggctgcaacgaaatgaaataacatgcttgcctcaaacaatcagcaatatgaaaaatctgggtactcttgttctcagcaacaataaactgcaagatattccagtatgcatggaagaaatggcaaatctgaggtttgtcaacttcagagacaacccactgaaattgaaagtatcacttcctcccagtgaaggcacagatgaagaagaggaacgggaattatttggccttcagtttatgcacacatacatacaagagtcacggagaagagcagatcaccaagtcaacggttcaactactttaccaatctccataaatacggatggataatataattcaagatgcccttctaaagaggattactttggtgaattctctaatgtttggatttctgaagtaaaaagaaaagctattaccaaagtttaatgaggccacagcattttttaaagttcatattatttgctatttaaagtatatatttttttgatataaaaatataattaaaaaattttttttggtggaagac

SEQ ID NO: 291632 - DNA, 1539 bp, Homo sapiens
taggctgaggattacatttcacttggttacagctgactggggattttaatcatttggagccacactgaaaaaaaaatttccccctgcaatctactcttaactgatagtcgctaactttggttatgtgtgtctattcagaatattacattaattgatttctcaaacaaaggtgtgcctctcataaacaacactcaggattttgtcttttctttaactggacaacctttgtatattaacttggaacacttaatcatcaggtcctttctgaaatggtatctatgattcagctattcaaaacctaatgaagttggtgactatgacaatgtggagaaatcatgacagaaaatgtggtttgtactggggctgtcaatgctgtaaaggaagtttgggaaaaaagaataaagaaactcaatgaagacctgaagcgagagaaggaatttcaacacaagctagtgcggatctgggaagaacgagtaagcttaaccaagctaagagaaaaggtcaccagggaagatggaagagtcattttgaagatagaaaaagaggaatggaagaccctcccttcttctctgctgaaactgaatcaactacaggaatggcaacttcatagaactggtttgctgaaaattcctgaattcattggaagattccagaacctcatggtgttagatttatctcgaaacacaatttcagagataccaccagggattggactgcttactagacttcaggaactgattctcaggtacaacaaaatcaagactgtccccaaggaactaagtaattgtgccagcttggagaaactagaactggctgttaacagagatatatgtgatcttccacaagagctcagcaatctgctaaaacttactcaccttgatctgagtatgaacgattttactacaatccctcttgctgtgttgaacatgcctgcccttgagtggctggacatgggaagcaacaaacttgaacaacttcctgatactatagaaagaatgcaaaatctacatacgttatggctgcaacgaaatgaaataacatgcttgcctcaaacaatcagcaatatgaaaaatctgggtactcttgttctcagcaacaataaactgcaagatattccagtatgcatggaagaaatggcaaatctgaggtttgtcaacttcagagacaacccactgaaattgaaagtatcacttcctcccagtgaaggcacagatgaagaagaggaacgggaattatttggccttcagtttatgcacacatacatacaagagtcacggagaagagcagatcaccaagtcaacggttcaactactttaccaatctccataaatacggatggataatataattcaagatgcccttctaaagaggattactttggtgaattctctaatgtttggatttctgaagtaaaaagaaaagctattaccaaagtttaatgaggccacagcattttttaaagttcatattatttgctatttaaagtatatatttttttgatataaaaatataattaaaaaattttttttggtggaagac

SEQ ID NO: 291633 - DNA, 321 bp, Homo sapiens
ataagctttgaaagtaagttgtctaaagctagtgtttttttttctcttaggaaaaaaacataagattcttgagatatatcacatctcaccaagtcgttcagttattgaaaccagttaaaaacgagtaatttagtatattatcatttgacctttctccagggaaataaatgtacacttccatgacacctataaaaatactgttttttgatgaacttctaggtttgtcaacttcagagacaacccactgaaattgaaagtatcacttcctcccagtgaaggcacagatgaagaagaggaacgggaattatttggccttcagtt

SEQ ID NO: 291634 - DNA, 807 bp, Homo sapiens
cagcaggatagaaaagtatagaggaaaaaggaagttccacctccatgatcctttagtcctctagctgttctccccagagaaagcaactctaagtttcttgcagaaaggacctggatacactagtagatgtaccataatttatgtaaacagtctgctattgaaggacattggtttgtttcccaccatcttccactccaaatcatgctgcagtgattatccctgagtgtatgtctctctgcacacagacaagggaatgagaagcagcaagttaaatgcagaacggaaatgaagctgttagaccaaattttcagcttctcacatggcacctctatctgtgaatacgattttctcacttgttagagcctctgtcacataatacacttgccacagaatactgccacagagaagagcaaaggaagacagctggctagccaaatgtccccacaatggaatagtgcctgaaagacccatgggggagctgtccatcagagccacactccccaccagctccttggaaggcacccccaaaagcaggagtggagagtccaaatgtcatctgccctcgaacaccacatgaaatggggagtacccttcactcagagagcagcccacccctcttcctcctttcagggagggttaccacagtggaagtgaagctcctcaacaagccttcagctctgtgatgaaattccctggtcctccacacctatccatccctgacagagtatgatcagtttgcttctatttctagtagaatatatttcacagcataatagttcaaagaaaccttacaaccctatccccaaa

SEQ ID NO: 291635 - DNA, 505 bp, Homo sapiens
cagcaggatagaaaagtatagaggaaaaaggaagttccacctccatgatcctttagtcctctagctgttctccccagagaaagcaactctaagtttcttgcagaaaggacctggatacactagtagatgtaccataatttatgtaaacagtctgctattgaaggacattggtttgtttcccaccatcttccactccaaatcatgctgcagtgattatccctgagtgtatgtctctctgcacacagagatgtggtctatgttgcccagggtggactcgaactcctggactcaagtgaccctcctgcctcagtctcccaagtagctgggactgcagacaagggaatgagaagcagcaagttaaatgcagaacggaaatgaagctgttagaccaaattttcagcttctcacatggtacaattattgtttttaatttctatgtaagcaagttcttaagtcacattgagaagatttttaaaaatccattaacaataatttacatccaaca

SEQ ID NO: 291636 - DNA, 406 bp, Homo sapiens
tcctgcatttttctgaagggcttttgtgactttggttccctgtgagcaagatgatctgcaagtggcgacatgaactgattaccaatcactgacttcaggaggaagcaagttctggaggctgggaagtccaagatcaaggcaggcgccagcagactctgggtctgacaagggaatgagaagcagcaagttaaatgcagaacggaaatgaagctgttagaccaaattttcagcttctcacatgggcacagattaccaaaagtgggactgctggcacaaagcatatgtgtgtattcatcgtgactgttactaccagattcttttccaagaaagttctaggcactaactttttttttaagactgcatgaagtatatctttttctaataatacagtatttcatggactata

SEQ ID NO: 291637 - DNA, 749 bp, Homo sapiens
gaagcagttagttggaatgggagcatctgcagtgatttgcccatggccattccagccccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaa

SEQ ID NO: 291638 - DNA, 760 bp, Homo sapiens
cgggctgcaggaattcggcacgagcatgatagcagcctggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaa

SEQ ID NO: 291639 - DNA, 670 bp, Homo sapiens
gttgcccattaaagaaatttggttaagttttgcagctcccaccaatgtgagatctcacacacatgcattttttaggcagctgaaccttttaagcattgcaacaccagctgttggtgcatggcttgttcccattgaccaactcaagtcatctttaaacaaattggaaactgagggaaccttgagaatttgtgctgttatgggatgcataatgacaggagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaa

SEQ ID NO: 291640 - DNA, 968 bp, Homo sapiens
cccggcggaaatgcccgagcgatgacggaaacccggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaa

SEQ ID NO: 291641 - DNA, 1186 bp, Homo sapiens
agcggggaaaaaaaaaaaaagaaatttaatggtgggtccccaaggatggggataccattgaccagagaaggggtaaagaagaaaaaatgatggacaaaatatgtttaaatgttggcactattgggactgacacttttaaccattatttactcttggttaactgttgggagttagtaaaacaaatacattctctttggttaattcatacatagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggaggtatgtactttcctgacagaatgatctttatttcagattagtatatacttctgtaataaggcattatgacttaactaagaaacattcctcaccatttattacctaggtgaaaagaggaaaaacttgctggttttagcaagtagggaaagcactagtagaccagagcagaattataactcatttttgaaattgagacttagaaaaaagttacaaaaatagtaccccataattccctgtatgcttcattcagattcctgactgtaaatattttactatatttgctttatcattttgtgtctctcttcctcttcacccctcacactttcttctgaaccatttgaatatctgttgcagacagatactcctttactaccaactttctatgtgtattttgtaaaattaaggacacactgtcacataaccaccgtatagttatcacagttgggaaatttgtgttcatatagtactgttatttaatatgaacactttattcaaattttgctaattgtctcactaatgtctttaatagcaaaatttaattttttgtgcatactgtatgtgcatagtcgaatccaaagattaggttgtattcattctactttgatgtggaaatcctccgattttcattgttttccacattcttgacattttggaagagtaggagcattttatcttacagaaatatccctcagttggggtttgcctgatgttttccttgcagt

SEQ ID NO: 291642 - DNA, 852 bp, Homo sapiens
caggtgcttcctctgtaaagtaagtatcgaaaccttcttccttctctgccagggttgtcgtgtggattaaataagaattgtaaagacgtatcattgactacaaaaaaacaaaacggaaatgctcaatgtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacaggtatgtatatgtgtgcttacatcttgggaggaggtaaatggaagcagagattgactattggtaagctggggtctagattcatatgacctgtgtttctgcatctcctcggccttttcctcctccttcccttatacttaaaatttcaaagcagggaagtggataagtttcacatacatttggaccagcaaattttcctgttgttctcagatatgtatgtaaatcttttaaccaaagaatatgctgtgctttttaagatatcgataaacattataaataaatgtttaagacactgatgtatagtactagcaaagcaagatgttatttaaaactatctctgcatatacatgcagtgtctgctggttaccatgaataacttttcatttctattttcatggtaactgcaaatgttatattgtgtattacaccttccctgagaagtgaatgcttggctgggcacagtggctagtactttgggaggccaaggcaagaggaccgcttgagttcaggggttcaagaccagcctgggcaatgtagtaagaccctgtctctac

SEQ ID NO: 291643 - DNA, 2002 bp, Homo sapiens
cccggcggaaatgcccgagcgatgacggaaacccggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaa

SEQ ID NO: 291644 - DNA, 1967 bp, Homo sapiens
cccggcggaaatgcccgagcgatgacggaaacccggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaa

SEQ ID NO: 291645 - DNA, 1956 bp, Homo sapiens
cccggcggaaatgcccgagcgatgacggaaacccggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcacttattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaa

SEQ ID NO: 291646 - DNA, 1948 bp, Homo sapiens
cccggcggaaatgcccgagcgatgacggaaacccggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacataaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaa

SEQ ID NO: 291647 - DNA, 1059 bp, Homo sapiens
agatttcaagcatagatacggcaaaacaacaattagcgagctgcatttaacagactcctaggcccacgaattgcacagtattctttacaggtacacaaactattaaagatggagaccttatatagtaatatagacgactacatttccacagagagtacctgtagtttttgagtttagttttttttaaatgtgtctgtgtcaaaatcataatattataatgaaataatgaatttgtttttatcctgcagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaa

SEQ ID NO: 291648 - DNA, 1674 bp, Homo sapiens
cccggcggaaatgcccgagcgatgacggaaacccggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgctggagtgcaatggtgtgatctcggctcactgcaacctccacctcccaagttcaaccgattctcctgcctcagcctcccaaatagctgggattacagacgatgatgatgatgattgagacatgatctcactctgtcacccaggctggagcacagaggtgagatcatggctcactgcaacctcaacctgtggggctccagtgatcctcccacctcagtctccagagtagctgagactacaggtgcaggcaatcacgcctggctaatt

SEQ ID NO: 291649 - DNA, 1913 bp, Homo sapiens
cccggcggaaatgcccgagcgatgacggaaacccggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggaggtatgtactttcctgacagaatgatctttatttcagattagtatatacttctgtaataaggcattatgacttaactaagaaacattcctcaccatttattacctaggtgaaaagaggaaaaacttgctggttttagcaagtagggaaagcactagtagaccagagcagaattataactcatttttgaaattgagacttagaaaaaagttacaaaaatagtaccccataattccctgtatgcttcattcagattcctgactgtaaatattttactatatttgctttatcattttgtgtctctcttcctcttcacccctcacactttcttctgaaccatttgaatatctgttgcagacagatactcctttactaccaactttctatgtgtattttgtaaaattaaggacacactgtcacataaccaccgtatagttatcacagttgggaaatttgtgttcatatagtactgttatttaatatgaacactttattcaaattttgctaattgtctcactaatgtctttaatagcaaaatttaattttttgtgcatactgtatgtgcatagtcgaatccaaagattaggttgtattcattctactttgatgtggaaatcctccgattttcattgttttccacattcttgacattttggaagagtaggagcattttatcttacagaaatatccctcagttggggtttgcctgatgttttccttgcagt

SEQ ID NO: 291650 - DNA, 491 bp, Homo sapiens
ggcaccaaaccagacattctgtcttcttaaattttcaccatagccctatgaagcagttagttggaatgggagcatctgcagtgatttgcccatggccattccagccgtaagtgatgtagtcatggtgggaaagcaggactgctgtttctactacagtgtcttgttctttattcatttgttttctttgcaaagtcagatcctttatttgcttccttttttgccatttacagccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagact

SEQ ID NO: 291651 - DNA, 1455 bp, Homo sapiens
cccggcggaaatgcccgagcgatgacggaaacccggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacaggtatgtatatgtgtgcttacatcttgggaggaggtaaatggaagcagagattgactattggtaagctggggtctagattcatatgacctgtgtttctgcatctcctcggccttttcctcctccttcccttatacttaaaatttcaaagcagggaagtggataagtttcacatacatttggaccagcaaattttcctgttgttctcagatatgtatgtaaatcttttaaccaaagaatatgctgtgctttttaagatatcgataaacattataaataaatgtttaagacactgatgtatagtactagcaaagcaagatgttatttaaaactatctctgcatatacatgcagtgtctgctggttaccatgaataacttttcatttctattttcatggtaactgcaaatgttatattgtgtattacaccttccctgagaagtgaatgcttggctgggcacagtggctagtactttgggaggccaaggcaagaggaccgcttgagttcaggggttcaagaccagcctgggcaatgtagtaagaccctgtctctac

SEQ ID NO: 291652 - DNA, 1935 bp, Homo sapiens
cccggcggaaatgcccgagcgatgacggaaacccggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaa

SEQ ID NO: 291653 - DNA, 1961 bp, Homo sapiens
cccggcggaaatgcccgagcgatgacggaaacccggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaa

SEQ ID NO: 291654 - DNA, 1998 bp, Homo sapiens
cccggcggaaatgcccgagcgatgacggaaacccggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagcttagcgtccagggagagtccagtatccatggacgaatttaatgtgaagagtgtagtgacttagaggttaacctcgaaggacaacagggctgtctgtcattagggagtagtgcttgtgcataagcaatttacagagatgatgttcccggtgccagtataaagctgacaatctatctgttgttatcggttcgatcaatgcatatttaaatcgtagtcaggcgttca

SEQ ID NO: 291655 - DNA, 1490 bp, Homo sapiens
cccggcggaaatgcccgagcgatgacggaaacccggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacaggtatgtatatgtgtgcttacatcttgggaggaggtaaatggaagcagagattgactattggtaagctggggtctagattcatatgacctgtgtttctgcatctcctcggccttttcctcctccttcccttatacttaaaatttcaaagcagggaagtggataagtttcacatacatttggaccagcaaattttcctgttgttctcagatatgtatgtaaatcttttaaccaaagaatatgctgtgctttttaagatatcgataaacattataaataaatgtttaagacactgatgtatagtactagcaaagcaagatgttatttaaaactatctctgcatatacatgcagtgtctgctggttaccatgaataacttttcatttctattttcatggtaactgcaaatgttatattgtgtattacaccttccctgagaagtgaatgcttggctgggcacagtggctagtactttgggaggccaaggcaagaggaccgcttgagttcaggggttcaagaccagcctgggcaatgtagtaagaccctgtctctac

SEQ ID NO: 291656 - DNA, 1434 bp, Homo sapiens
gggccccaggaggcgagtctgagtggaacctggctggggtaggctgaaaggtgacttcgacgctcttctgaggcctcagacgtgtgtgatgactgccctgtagaatcagtgctgtgaccccgagtaacaacgcgcgcttgagttggtataaactcctgaagagtgtagtcctgcaatttacaagaaaaagttaagtgtaaaatagcctcaggcatgtccttcaggagggattccagaggcattgttatagacgatgacagctctgtgtgtgttattgccactgaagaccttccatgggacgcgatgtggagctggaagtcagtgatattgatgatcctgacacagtcctaggataaggatctttaactttattagcagctactgagctacagaatacaaaccaactgaaaacattaaagaaaggcttcctgaaacagctcttcaaacctctgggaaagatcatcaaagtcaatgtcttcagatgctgaggtgctggcaccagcaaatgcagttggtagtgtgtctggcacagatggcaactctggtaggacaaagttgtcatagttatccgcaggtcaggaaggaagctttgcagaggcttctggcttgggtccaggaccaacaatctgtgcagaagagatattcttatcagcattaatgtcatctacagattcatatgatgggggagttgctggtatctgagatggataaatattgggaaaggcctgccacttctgactggagtcgaggagcagcccaggtcaatgtagacacagattcagccagaccagaatctagttccttcatagactggataaggccaaaccgagccagcagcagatcacagtacagctccaggatctccatggcctccacgaagtagtcttcccggataatgtgctccacacggatccgagctcgttcatctttcccagcagccagatagtcagcaatctccttccttgctttctgggccagttctgtttttttttttttcctccaatagttcaaggcgatttatgactaatctcaaattcactcttaagtgctcagctttaaatccagagcccagcatgctgtgctgttcctcctaaccgaatcctgccatgaacacagcagacaccgacttcagaatcagggttcaccatccaccactatcccccaggcgatgatgtcttatcatccaggtctctctcttcagaaagaatcccaacaggtgcgtttagccagaatcctacttatcccagacatttcctcttagtattttgtcatccagtgatccctaacctgctccttgactataaattcctactcgttcatgctgaatttggagttgaacccaatctcttgtacccattgcaaaatctcactgctgtgcttccaatacctatcacgatgatcctgaataaagtcttcctttgcatgctttaacga

SEQ ID NO: 291657 - DNA, 1030 bp, Homo sapiens
gggccccaggaggcgagtctgagtggaacctggctggggtaggctgaaaggtgacttcgacgctcttctgaggcctcagacgtgtgtgatgactgccctgtagaatcagtgctgtgaccccgagtaacaacgcgcgcttgagttggtataaactcctgaagagtgtagtcctgcaatttacaagaaaaagttaagtgtaaaatagcctcaggcatgtccttcaggagggattccagaggcattgttatagacgatgacagctctgtgtgtgttattgccactgaagaccttccatgggacgcgatgtggagctggaagtcagtgatattgatgatcctgacacagtcctaggataaggatctttaactttattagcagctactgagctacagaatacaaaccaactgaaaacattaaagaaaggcttcctgaaacagctcttcaaacctctgggaaagatcatcaaagtcaatgtcttcagatgctgaggtgctggcaccagcaaatgcagttggtagtgtgtctggcacagatggcaactctggtaggacaaagttgtcatagttatccgcaggtcaggaaggaagctttgcagaggcttctggcttgggtccaggaccaacaatctgtgcagaagagatattcttatcagcattaatgtcatctacagattcatatgatgggggagttgctggtatctgagatggataaatattgggaaaggcctggtaagtccccattggcagtccattgaaatctgatggtccctttggcagtggatatgagaaaggagtatttgcagatggcatgggcataggcatgggcattggcaccattccatcaggtccaccaactggtgctgtgaacccaccaccccctcctcttccagggcctcctttcttcacatcatctgtgaatccaacatcaataagatctgtctctaccccagaaggagcttctgccatgaccacagagtcaggttcatagggtacattgtaattcttcgcaattcaatcaggtatctctccac

SEQ ID NO: 291658 - DNA, 656 bp, Homo sapiens
ttgttacaaggagaaattgctcagtctcaactcccagaatatgaaagttgcctggtttaagagacctatattttctttttcagctcttcaaacctctgggaaagatcatcaaagtcaatgtcttcagatgctgaggtgctggcaccagcaaatgcagttggtagtgtgtctggcacagatggcaactctggtaggacaaagttgtcatagttatccgcaggtcaggaaggaagctttgcagaggcttctggcttgggtccaggaccaacaatctgtgcagaagagatattcttatcagcattaatgtcatctacagattcatatgatgggggagttgctggtatctgagatggataaatattgggaaaggcctggtaagtccccattggcagtccattgaaatctgatggtccctttggcagtggatatgagaaaggagtatttgcagatggcatgggcataggcatgggcattggcaccattccatcaggtccaccaactggtgctgtgaacccaccaccccctcctcttccagggcctcctttcttcacatcatctgtgaatccaacatcaataagatctgtctctaccccagaaggagcttctgccatgaccacagagtcaggttcatagggtacattgtaattcttcgcaat

SEQ ID NO: 291659 - DNA, 725 bp, Homo sapiens
acgctaggtcaagggcggtgttcctgtgttcttagggccccaggaggcgagtctgagtggaacctggctggggtaggctgaaaggtgacttcgacgctcttctgaggcctcagacgtgtgtgatgactgccctgtagaatcagtgctgtgaccccgagtaacaacgcgcgcttgagttggtataaactcctgaaggtaggtttataatgtacaattctgtacgcttgtgtaatactttttgtattttgcatggatgggctttgctgcattttaaagcccatagactggagaaacatctttcattggtaatgcctggtcatgagatcccaagacagtgaagataaattgtggccaaacgcccaaaatctgggtagaaggtgctgtcagaagaattgagccaggcgtggtggctcatgcctgtaatgccagcactttgggaggcggaggtgggaggattgcttgagcctgggagttcgccaccagcatgggcaacatagcaagaccctgactctgcaaaaaataaaaaggttcgaacctgtggtcccagctactcaggaggctgaggtgggaggacggcttgagcctgggaagtcgaggctgcagtgccactctaaccttggtgacagagggagaccttgtcttaaaaaaaaaaaaaggaaccaaggttgtgtttatatgtatttatgttcatgaggacattgagcaaatgggaaacatactcatca

SEQ ID NO: 291660 - DNA, 409 bp, Homo sapiens
accactgcactccagcctgggcaacagagcaaggctctgtctcaaaaacaaaaacaaatgcaccctggtgttaggctgcatccatcccattagtggacaggggtagcggggaggtttgttagattcaaacaagtgttttatgggcaagcagccccaccccagccccacacaaaccacactccctatccccattactctggctaatttttcttttcatagtacccatcaccttctaacatattatataatttatttacctaatatatttattgtctgttttccccctagaaaaatgaactcacttctgttctctactacactaaaacaatgcttagcacataaccaggacctggcacctatttgttaaatgaatgaatgaatgaatgactaaataaatgaaaaaaaaaaa

SEQ ID NO: 291661 - DNA, 399 bp, Homo sapiens
ccgcgtgcatgctgggctctcctggctcagctgctttcacacattgccgatcagcagcagcagcagtgaaggagaacttaagtggccgtgcccacctgctgctgcttgggtcctgtgcacaagctgttcccgctgcctccaatactcatcccctcgacttctatggagctgactcttcaccttccagccttggctcaaatgtcaccttcacagtaaaggctacccatggctgggtgtgtggttgtgcaggatctgccccttccaaagggccagaatggaaaaatgaactcacttctgttctctactacactaaaacaatgcttagcacataaccaggacctggcacctatttgttaaatgaatgaatgaatgaatgactaaataaatgaaaaaaaaaaa

SEQ ID NO: 291662 - DNA, 1082 bp, Homo sapiens
agtgcttggcacacggtccccaggagcttcccccgaaggttcccccgaagccagccacagctgctcagctcggcgcgcggagcccgcggtggtaccgagtccgcacaaacccggacccgctccaagtgagccgcgttgtcgtcattcattcgcagtgtccggagcgtccttccagcggggagctgggcttccctagtggcgcctgcggccccgacacggcgcgttaaggcgcggcgacttcgggagctcgagcaggtagagacgggaggggctctggagctccagtcggcgccgcgggagcagcagcgccggagcccagcttggccctgaccgcggggccgaatccgctcgggtggcccttagccctgcctggcgctgagccggatcccgggactgagctataccacttcctcctcctcccgctcccttcctcctcctcttcctcctcctcccgctcctcccgccgccgtgggccgggagccgggctgcagagtgccaggccgggcgtctgcggccgcgggctctcgcggggcggcgacgccgcggggaggatgctgcttgccgcgcccgcgtcctcaccgtcctcccgggccgcctgctggggctttgttgtggcccggacgccgcgggccaccccctgaagtcgcctgccgccgccgccgccgcacctagcggacgggcgggcgggcgcgcgtgtgcccaggagtgcgcgcctgtcgcggtggtgggtgcaggactggacccacgggcccattgtgcgcccgcccgcggcagccaggaccatgtgggtgaacccggaggaggtgttgctggccaacgcgctgtggatcaccgagagggccaacccatacttcatcctgcagcggaggaagggccacgccggcgatggaggcggcggcggcggactggcgggcctgctggtgggtacccttgatgttgtgttggactccagcgcccgggtcgctccttaccgaatcttgtaccagactccagactccctggtctactggaccatcgcctgtgggtggttccaggaaagaaatcactgaacactggggaatgggttgagcaaaatctcttgc

SEQ ID NO: 291663 - DNA, 454 bp, Homo sapiens
  misc_feature (88)..(88): n is a, c, g, or t
ggaccacctgtcagaacaaggggccgatgacagcaagcctgagacagacagggttccaggtgacggtggccaaaaggaacacctaccnagcattgatttctcaaggggaagataaaatgactaagaggaagaagctgcggacctcagctcccctgatgaggaaacaggatctccctgccggctcctccgtcaaccagaaaaggagccagctccccttcctccttcccagaactcattcgggaggtttgttccccagtttgcaaaatccaggaagctggccacctctgagcagggcccatcctgtccggatttgcaaattttagggtcctgagccaagtatggatggttcagaatttgtttctttcctggaggagaagagagctccctttgttttctttctccccatttccattttatttcttctgggaagacccataataaatgattctgtaga

SEQ ID NO: 291664 - DNA, 2594 bp, Homo sapiens
gcgcctctgcccgggggtcccgggggtcctttcctcttgtgcatcttcaaggctggatgcccggaccacctgcccccaagcccggccttgccctgcctccttccccgggctctgtcgccgcgcactcgcccttcctgagtcctgcactcctcgtcggcgccccgcggccgtcgatcccgagccctcgcttccctgcttggccgtcccacttccgcctcgggcctcgggcgccgccgcaccggagcgcggccactgggctcgccgggtctgccgagccgaaactacaactcccggcagatttctcaaggggaagataaaatgactaagaggaagaagctgcggacctcagctcccctgatgaggaaacaggatctccctgccggctcctccgtcaaccagaaaaggagccagctccccttcctccttcccagaactcattcgggaggtttgttccccagtttgcaaaatccaggaagacagtgacaagaaaagaagagatgaaggatgaggaccgtgggagtggggcctttagcctggaaacaatcgcagagtccagcgcccagagtccaggatgccagctgctagtggagaccctgggggtccccctccaggaggccacggagctgggggacccaacgcaggcagacagtgcccgccctgagcagagcagccagagccctgtgcaggcggtgcccggcagtggggattctcagcctgatgaccctccagacagggggacggggttgtccgcctcacagagggccagccaagaccacctgtcagaacaaggggccgatgacagcaagcctgagacagacagggttccaggtgacggtggccaaaaggaacacctaccaagcattgattctgaaggggagaagccagacagaggagccccccaggagggaggggcccaaaggacagcaggggctggcctgcctggagggccccaggaggagggagacggtgtcccctgtaccccagcatcagctcctacctcaggccctgctccaggactgggccctgcctcttggtgcctggaacccgggtctgtggcccagggctcccctgacccccagcagacccccagcaggatgggtagggaaggggaagggactcatagcagcctgggatgctcctccctcgggatggttgtcatcgcagacctgagcacagaccccactgagctggaagagagggctctggaggtggctgggcccgatgggcaggccagtgccatatcacctgcctctcccaggaggaaggccgctgatggaggccacaggagggccttgccaggctgcacctcgctcactggggaaaccacaggagaaagtggggaggcagggcaggatggcaagccccccggcgatgtcctagtgggccctacagcctccctggctctggcacctgggagcggagagtccatgatgggtgctggagattccggtcatgcatccccggacacaggtccatgtgtcaatcagaagcaggagccaggtcctgctcaagaggaagccgagttaggtggccagaacctcgaacgagacctcgaggggttccgtgtgtccccgcaagcctctgttgtgctggaacacagagaaatagcagacgaccctctccaggagcccggggctcagcagggcattccagacaccacctcagagctggcagggcagcgagaccacctgcctcattctgcagaccagggcacctgggcagactctttagctgtggaactcgacttcctgctggacagccagatacaggatgccctggacgcctctgacttcgaagccccacctgagcagctctttccttcggggaacaagccgggcccttgctggccgggccccagctcacatgccaatggagaccctgttgcagtggccaaggcccagccgaggaccttcgtggggatccaggcctctgaggcctccaggatggaggatgccaccaacgtcgtgcgtggcctcatcgttgagctctccaacctgaaccggctgatcatgggcacccaccgggacctggaagctttcaagcgccttaactaccggaagacaaagctgggaggcaaagcccccctgccttacccttccaaggggcctgggaatatccctcgaggggacccaccctggagggagttgtaggccactttgaggtctgtgtttcctttgccacccagcccccatgtccgcagacctcctccaagatgctccagggggtcctagtggaccctacaaacctcccttcagttgcccggaagttggtcttccatggacaacacaaaggaggccgtgaggtcctggcctcacctggccagggtcaaggtcatttgccacccttggcttcagggagggaaactgtgtctcccacagccccagtgacttcaagcgggcctgggctccaggaagctggccacctctgagcagggcccatcctgtccggatttgcaaattttagggtcctgagccaagtatggatggttcagaatttgtttctttcctggaggagaagagagctccctttgttttctttctccccatttccattttatttcttctgggaagacccataataaatgattctgtaga

SEQ ID NO: 291665 - DNA, 3150 bp, Homo sapiens
gcgcctctgcccgggggtcccgggggtcctttcctcttgtgcatcttcaaggctggatgcccggaccacctgcccccaagcccggccttgccctgcctccttccccgggctctgtcgccgcgcactcgcccttcctgagtcctgcactcctcgtcggcgccccgcggccgtcgatcccgagccctcgcttccctgcttggccgtcccacttccgcctcgggcctcgggcgccgccgcaccggagcgcggccactgggctcgccgggtctgccgagccgaaactacaactcccggcaggtagtgcgtgggcgcgcaggcgcctggctggggcggtgctgactgtcgcgggctgcgagggcggtgtttgcgtcgctcatgcgcggggcgggacctcgcggggcgcgggaaagaggcagagcgcgcgcaggtgtgaggggcggcgacatctgtggggttcagagcgtctgtcagtcaccgacgggctccggcttcacgtgggctctcggcctgtggagtcctcacttctcggtggtcggcgtagtgtcagtgtggggcttgtcaccgggagcggggtctacagcgcccaccctcaggcctttccatctttcacctccggactcgaggcctccagcgttctgtgagggccaatttggccatttattttttccaaaaagagtaacgcggataattcaagcgacttattcccaactgatccaggcagagctcgtttctgataaggacagagggtcctcaacgacttctgtggcccagatttctcaaggggaagataaaatgactaagaggaagaagctgcggacctcaggagagggactctgtcctccaaaacccctaaagaacccaaggctaggagacttctatggggacccccagagttccatgttgggctgtttacatcaccctgaggagccagagggcaaattgggacctgttccctctacacagcagcacggggaggaaccaggaaaggccgtctccagctcccctgatgaggaaacaggatctccctgccggctcctccgtcaaccagaaaaggagccagctccccttcctccttcccagaactcattcgggaggtttgttccccagtttgcaaaatccaggaagacagtgacaagaaaagaagagatgaaggatgaggaccgtgggagtggggcctttagcctggaaacaatcgcagagtccagcgcccagagtccaggatgccagctgctagtggagaccctgggggtccccctccaggaggccacggagctgggggacccaacgcaggcagacagtgcccgccctgagcagagcagccagagccctgtgcaggcggtgcccggcagtggggattctcagcctgatgaccctccagacagggggacggggttgtccgcctcacagagggccagccaagaccacctgtcagaacaaggggccgatgacagcaagcctgagacagacagggttccaggtgacggtggccaaaaggaacacctaccaagcattgattctgaaggggagaagccagacagaggagccccccaggagggaggggcccaaaggacagcaggggctggcctgcctggagggccccaggaggagggagacggtgtcccctgtaccccagcatcagctcctacctcaggccctgctccaggactgggccctgcctcttggtgcctggaacccgggtctgtggcccagggctcccctgacccccagcagacccccagcaggatgggtagggaaggggaagggactcatagcagcctgggatgctcctccctcgggatggttgtcatcgcagacctgagcacagaccccactgagctggaagagagggctctggaggtggctgggcccgatgggcaggccagtgccatatcacctgcctctcccaggaggaaggccgctgatggaggccacaggagggccttgccaggctgcacctcgctcactggggaaaccacaggagaaagtggggaggcagggcaggatggcaagccccccggcgatgtcctagtgggccctacagcctccctggctctggcacctgggagcggagagtccatgatgggtgctggagattccggtcatgcatccccggacacaggtccatgtgtcaatcagaagcaggagccaggtcctgctcaagaggaagccgagttaggtggccagaacctcgaacgagacctcgaggggttccgtgtgtccccgcaagcctctgttgtgctggaacacagagaaatagcagacgaccctctccaggagcccggggctcagcagggcattccagacaccacctcagagctggcagggcagcgagaccacctgcctcattctgcagaccagggcacctgggcagactctttagctgtggaactcgacttcctgctggacagccagatacaggatgccctggacgcctctgacttcgaagccccacctgagcagctctttccttcggggaacaagccgggcccttgctggccgggccccagctcacatgccaatggagaccctgttgcagtggccaaggcccagccgagccggctgatcatgggcacccaccgggacctggaagctttcaagcgccttaactaccggaagacaaagctgggaggcaaagcccccctgccttacccttccaaggggcctgggaatatccctcgaggggacccaccctggagggagttgtaggccactttgaggtctgtgtttcctttgccacccagcccccatgtccgcagacctcctccaagatgctccagggggtcctagtggaccctacaaacctcccttcagttgcccggaagttggtcttccatggacaacacaaaggaggccgtgaggtcctggcctcacctggccagggtcaaggtcatttgccacccttggcttcagggagggaaactgtgtctcccacagccccagtgacttcaagcgggcctgggctccaggaagctggccacctctgagcagggcccatcctgtccggatttgcaaattttagggtcctgagccaagtatggatggttcagaatttgtttctttcctggaggagaagagagctccctttgttttctttctccccatttccattttatttcttctgggaagacccataataaatgattctgtaga

SEQ ID NO: 291666 - DNA, 2673 bp, Homo sapiens
gcgcctctgcccgggggtcccgggggtcctttcctcttgtgcatcttcaaggctggatgcccggaccacctgcccccaagcccggccttgccctgcctccttccccgggctctgtcgccgcgcactcgcccttcctgagtcctgcactcctcgtcggcgccccgcggccgtcgatcccgagccctcgcttccctgcttggccgtcccacttccgcctcgggcctcgggcgccgccgcaccggagcgcggccactgggctcgccgggtctgccgagccgaaactacaactcccggcaggtagtgcgtgggcgcgcaggcgcctggctggggcggtgctgactgtcgcgggctgcgagggcggtgtttgcgtcgctcatgcgcggggcgggacctcgcggggcgcgggaaagaggcagagcgcgcgcaggtgtgaggggcggcgacatctgtggggttcagagcgtctgtcagtcaccgacgggctccggcttcacgtgggctctcggcctgtggagtcctcacttctcggtggtcggcgtagtgtcagtgtggggcttgtcaccgggagcggggtctacagcgcccaccctcaggcctttccatctttcacctccggactcgaggcctccagcgttctgtgagggccaatttggccatttattttttccaaaaagagtaacgcggataattcaagcgacttattcccaactgatccaggcagagctcgtttctgataaggacagagggtcctcaacgacttctgtggcccagatttctcaaggggaagataaaatgactaagaggaagaagctgcggacctcaggagagggactctgtcctccaaaacccctaaagaacccaaggctaggagacttctatggggacccccagagttccatgttgggctgtttacatcaccctgaggagccagagggcaaattgggacctgttccctctacacagcagcacggggaggaaccaggaaaggccgtctccagctcccctgatgaggaaacaggatctccctgccggctcctccgtcaaccagaaaaggagccagctccccttcctccttcccagaactcattcgggaggtttgttccccagtttgcaaaatccaggaagacagtgacaagaaaagaagagatgaaggatgaggaccgtgggagtggggcctttagcctggaaacaatcgcagagtccagcgcccagagtccaggatgccagctgctagtggagaccctgggggtccccctccaggaggccacggagctgggggacccaacgcaggcagacagtgcccgccctgagcagagcagccagagccctgtgcaggcggtgcccggcagtggggattctcagcctgatgaccctccagacagggggacggggttgtccgcctcacagagggccagccaagaccacctgtcagaacaaggggccgatgacagcaagcctgagacagacagggttccaggtgacggtggccaaaaggaacacctaccaagcattgattctgaaggggagaagccagacagaggagccccccaggagggaggggcccaaaggacagcaggggctggcctgcctggagggccccaggaggagggagacggtgtcccctgtaccccagcatcagctcctacctcaggccctgctccaggactgggccctgcctcttggtgcctggaacccgggtctgtggcccagggctcccctgacccccagcagacccccagcaggatgggtagggaaggggaagggactcatagcagcctgggatgctcctccctcgggatggttgtcatcgcagacctgagcacagaccccactgagctggaagagagggctctggaggtggctgggcccgatgggcaggccagtgccatatcacctgcctctcccaggaggaaggccgctgatggaggccacaggagggccttgccaggctgcacctcgctcactggggaaaccacaggagaaagtggggaggcagggcaggatggcaagccccccggcgatgtcctagtgggccctacagcctccctggctctggcacctgggagcggagagtccatgatgggtgctggagattccggtcatgcatccccggacacaggtccatgtgtcaatcagaagcaggagccaggtcctgctcaagaggaagccgagttaggtggccagaacctcgaacgagacctcgaggggttccgtgtgtccccgcaagcctctgttgtgctggaacacagagaaatagcagacgaccctctccaggagcccggggctcagcagggcattccagacaccacctcagagctggcagggcagcgagaccacctgcctcattctgcagaccagggcacctgggcagactctttagctgtggaactcgacttcctgctggacagccagatacaggatgccctggacgcctctgacttcgaagccccacctgagcagctctttccttcggggaacaagccgggcccttgctggccgggccccagctcacatgccaatggagaccctgttgcagtggccaaggcccagccgaggccaccagtgagccgtcctccagcctgctgtgtgtgaggagggcaccctctcccccgcaccatgcccggggtctccgcagcctgtcccctcctcccgtgccctcccacagccctcctc

SEQ ID NO: 291667 - DNA, 457 bp, Homo sapiens
gtacggggtgggcttggactcacggcacagggtctgcgggaggccagtggggactcagaggagcagggagggactgaagtgtgaagcccctaggtgggcagcgagggtcaggcacctcactgctgctgggtcctcaccgtggcccccctcccccgtcctttgcagaacacaggctctgaagaaaggctgcaacaggcccagcctgtgctacaacaggccctttctggttatgtgcacgtgtgtgagccgtgtgtgtgcacctgagtcattggtgaccatgtggctgtgaggcgcggccccctctgtcacctggtgaccactgagccccacacgcatgcctgtgtttcccccacagccggctgatcatgggcacccaccgggacctggaagctttcaagcgccttaactaccggaagacaaagctgggaggcaaagcccccctgccttacccttccaa

SEQ ID NO: 291668 - DNA, 3243 bp, Homo sapiens
gcgcctctgcccgggggtcccgggggtcctttcctcttgtgcatcttcaaggctggatgcccggaccacctgcccccaagcccggccttgccctgcctccttccccgggctctgtcgccgcgcactcgcccttcctgagtcctgcactcctcgtcggcgccccgcggccgtcgatcccgagccctcgcttccctgcttggccgtcccacttccgcctcgggcctcgggcgccgccgcaccggagcgcggccactgggctcgccgggtctgccgagccgaaactacaactcccggcaggtagtgcgtgggcgcgcaggcgcctggctggggcggtgctgactgtcgcgggctgcgagggcggtgtttgcgtcgctcatgcgcggggcgggacctcgcggggcgcgggaaagaggcagagcgcgcgcaggtgtgaggggcggcgacatctgtggggttcagagcgtctgtcagtcaccgacgggctccggcttcacgtgggctctcggcctgtggagtcctcacttctcggtggtcggcgtagtgtcagtgtggggcttgtcaccgggagcggggtctacagcgcccaccctcaggcctttccatctttcacctccggactcgaggcctccagcgttctgtgagggccaatttggccatttattttttccaaaaagagtaacgcggataattcaagcgacttattcccaactgatccaggcagagctcgtttctgataaggacagagggtcctcaacgacttctgtggcccagatttctcaaggggaagataaaatgactaagaggaagaagctgcggacctcaggagagggactctgtcctccaaaacccctaaagaacccaaggctaggagacttctatggggacccccagagttccatgttgggctgtttacatcaccctgaggagccagagggcaaattgggacctgttccctctacacagcagcacggggaggaaccaggaaaggccgtctccagctcccctgatgaggaaacaggatctccctgccggctcctccgtcaaccagaaaaggagccagctccccttcctccttcccagaactcattcgggaggtttgttccccagtttgcaaaatccaggaagacagtgacaagaaaagaagagatgaaggatgaggaccgtgggagtggggcctttagcctggaaacaatcgcagagtccagcgcccagagtccaggatgccagctgctagtggagaccctgggggtccccctccaggaggccacggagctgggggacccaacgcaggcagacagtgcccgccctgagcagagcagccagagccctgtgcaggcggtgcccggcagtggggattctcagcctgatgaccctccagacagggggacggggttgtccgcctcacagagggccagccaagaccacctgtcagaacaaggggccgatgacagcaagcctgagacagacagggttccaggtgacggtggccaaaaggaacacctaccaagcattgattctgaaggggagaagccagacagaggagccccccaggagggaggggcccaaaggacagcaggggctggcctgcctggagggccccaggaggagggagacggtgtcccctgtaccccagcatcagctcctacctcaggccctgctccaggactgggccctgcctcttggtgcctggaacccgggtctgtggcccagggctcccctgacccccagcagacccccagcaggatgggtagggaaggggaagggactcatagcagcctgggatgctcctccctcgggatggttgtcatcgcagacctgagcacagaccccactgagctggaagagagggctctggaggtggctgggcccgatgggcaggccagtgccatatcacctgcctctcccaggaggaaggccgctgatggaggccacaggagggccttgccaggctgcacctcgctcactggggaaaccacaggagaaagtggggaggcagggcaggatggcaagccccccggcgatgtcctagtgggccctacagcctccctggctctggcacctgggagcggagagtccatgatgggtgctggagattccggtcatgcatccccggacacaggtccatgtgtcaatcagaagcaggagccaggtcctgctcaagaggaagccgagttaggtggccagaacctcgaacgagacctcgaggggttccgtgtgtccccgcaagcctctgttgtgctggaacacagagaaatagcagacgaccctctccaggagcccggggctcagcagggcattccagacaccacctcagagctggcagggcagcgagaccacctgcctcattctgcagaccagggcacctgggcagactctttagctgtggaactcgacttcctgctggacagccagatacaggatgccctggacgcctctgacttcgaagccccacctgagcagctctttccttcggggaacaagccgggcccttgctggccgggccccagctcacatgccaatggagaccctgttgcagtggccaaggcccagccgaggaccttcgtggggatccaggcctctgaggcctccaggatggaggatgccaccaacgtcgtgcgtggcctcatcgttgagctctccaacctgaaccggctgatcatgggcacccaccgggacctggaagctttcaagcgccttaactaccggaagacaaagctgggaggcaaagcccccctgccttacccttccaaggggcctgggaatatccctcgaggggacccaccctggagggagttgtaggccactttgaggtctgtgtttcctttgccacccagcccccatgtccgcagacctcctccaagatgctccagggggtcctagtggaccctacaaacctcccttcagttgcccggaagttggtcttccatggacaacacaaaggaggccgtgaggtcctggcctcacctggccagggtcaaggtcatttgccacccttggcttcagggagggaaactgtgtctcccacagccccagtgacttcaagcgggcctgggctccaggaagctggccacctctgagcagggcccatcctgtccggatttgcaaattttagggtcctgagccaagtatggatggttcagaatttgtttctttcctggaggagaagagagctccctttgttttctttctccccatttccattttatttcttctgggaagacccataataaatgattctgtaga

SEQ ID NO: 291669 - DNA, 2899 bp, Homo sapiens
gcgcctctgcccgggggtcccgggggtcctttcctcttgtgcatcttcaaggctggatgcccggaccacctgcccccaagcccggccttgccctgcctccttccccgggctctgtcgccgcgcactcgcccttcctgagtcctgcactcctcgtcggcgccccgcggccgtcgatcccgagccctcgcttccctgcttggccgtcccacttccgcctcgggcctcgggcgccgccgcaccggagcgcggccactgggctcgccgggtctgccgagccgaaactacaactcccggcaggtagtgcgtgggcgcgcaggcgcctggctggggcggtgctgactgtcgcgggctgcgagggcggtgtttgcgtcgctcatgcgcggggcgggacctcgcggggcgcgggaaagaggcagagcgcgcgcagatttctcaaggggaagataaaatgactaagaggaagaagctgcggacctcaggagagggactctgtcctccaaaacccctaaagaacccaaggctaggagacttctatggggacccccagagttccatgttgggctgtttacatcaccctgaggagccagagggcaaattgggacctgttccctctacacagcagcacggggaggaaccaggaaaggccgtctccagctcccctgatgaggaaacaggatctccctgccggctcctccgtcaaccagaaaaggagccagctccccttcctccttcccagaactcattcgggaggtttgttccccagtttgcaaaatccaggaagacagtgacaagaaaagaagagatgaaggatgaggaccgtgggagtggggcctttagcctggaaacaatcgcagagtccagcgcccagagtccaggatgccagctgctagtggagaccctgggggtccccctccaggaggccacggagctgggggacccaacgcaggcagacagtgcccgccctgagcagagcagccagagccctgtgcaggcggtgcccggcagtggggattctcagcctgatgaccctccagacagggggacggggttgtccgcctcacagagggccagccaagaccacctgtcagaacaaggggccgatgacagcaagcctgagacagacagggttccaggtgacggtggccaaaaggaacacctaccaagcattgattctgaaggggagaagccagacagaggagccccccaggagggaggggcccaaaggacagcaggggctggcctgcctggagggccccaggaggagggagacggtgtcccctgtaccccagcatcagctcctacctcaggccctgctccaggactgggccctgcctcttggtgcctggaacccgggtctgtggcccagggctcccctgacccccagcagacccccagcaggatgggtagggaaggggaagggactcatagcagcctgggatgctcctccctcgggatggttgtcatcgcagacctgagcacagaccccactgagctggaagagagggctctggaggtggctgggcccgatgggcaggccagtgccatatcacctgcctctcccaggaggaaggccgctgatggaggccacaggagggccttgccaggctgcacctcgctcactggggaaaccacaggagaaagtggggaggcagggcaggatggcaagccccccggcgatgtcctagtgggccctacagcctccctggctctggcacctgggagcggagagtccatgatgggtgctggagattccggtcatgcatccccggacacaggtccatgtgtcaatcagaagcaggagccaggtcctgctcaagaggaagccgagttaggtggccagaacctcgaacgagacctcgaggggttccgtgtgtccccgcaagcctctgttgtgctggaacacagagaaatagcagacgaccctctccaggagcccggggctcagcagggcattccagacaccacctcagagctggcagggcagcgagaccacctgcctcattctgcagaccagggcacctgggcagactctttagctgtggaactcgacttcctgctggacagccagatacaggatgccctggacgcctctgacttcgaagccccacctgagcagctctttccttcggggaacaagccgggcccttgctggccgggccccagctcacatgccaatggagaccctgttgcagtggccaaggcccagccgaggaccttcgtggggatccaggcctctgaggcctccaggatggaggatgccaccaacgtcgtgcgtggcctcatcgttgagctctccaacctgaaccggctgatcatgggcacccaccgggacctggaagctttcaagcgccttaactaccggaagacaaagctgggaggcaaagcccccctgccttacccttccaaggggcctgggaatatccctcgaggggacccaccctggagggagttgtaggccactttgaggtctgtgtttcctttgccacccagcccccatgtccgcagacctcctccaagatgctccagggggtcctagtggaccctacaaacctcccttcagttgcccggaagttggtcttccatggacaacacaaaggaggccgtgaggtcctggcctcacctggccagggtcaaggtcatttgccacccttggcttcagggagggaaactgtgtctcccacagccccagtgacttcaagcgggcctgggctccaggaagctggccacctctgagcagggcccatcctgtccggatttgcaaattttagggtcctgagccaagtatggatggttcagaatttgtttctttcctggaggagaagagagctccctttgttttctttctccccatttccattttatttcttctgggaagacccataataaatgattctgtaga

SEQ ID NO: 291670 - DNA, 1968 bp, Homo sapiens
gcgcctctgcccgggggtcccgggggtcctttcctcttgtgcatcttcaaggctggatgcccggaccacctgcccccaagcccggccttgccctgcctccttccccgggctctgtcgccgcgcactcgcccttcctgagtcctgcactcctcgtcggcgccccgcggccgtcgatcccgagccctcgcttccctgcttggccgtcccacttccgcctcgggcctcgggcgccgccgcaccggagcgcggccactgggctcgccgggtctgccgagccgaaactacaactcccggcaggtagtgcgtgggcgcgcaggcgcctggctggggcggtgctgactgtcgcgggctgcgagggcggtgtttgcgtcgctcatgcgcggggcgggacctcgcggggcgcgggaaagaggcagagcgcgcgcaggtgtgaggggcggcgacatctgtggggttcagagcgtctgtcagtcaccgacgggctccggcttcacgtgggctctcggcctgtggagtcctcacttctcggtggtcggcgtagtgtcagtgtggggcttgtcaccgggagcggggtctacagcgcccaccctcaggcctttccatctttcacctccggactcgaggcctccagcgttctgtgagggccaatttggccatttattttttccaaaaagagtaacgcggataattcaagcgacttattcccaactgatccaggcagagctcgtttctgataaggacagagggtcctcaacgacttctgtggcccagatttctcaaggggaagataaaatgactaagaggaagaagctgcggacctcaggagagggactctgtcctccaaaacccctaaagaacccaaggctaggagacttctatggggacccccagagttccatgttgggctgtttacatcaccctgaggagccagagggcaaattgggacctgttccctctacacagcagcacggggaggaaccaggaaaggccgtctccagctcccctgatgaggaaacaggatctccctgccggctcctccgtcaaccagaaaaggagccagctccccttcctccttcccagaactcattcgggaggtttgttccccagtttgcaaaatccaggaagacagtgacaagaaaagaagagatgaaggatgaggaccgtgggagtggggcctttagcctgctctttccttcggggaacaagccgggcccttgctggccgggccccagctcacatgccaatggagaccctgttgcagtggccaaggcccagccgaggaccttcgtggggatccaggcctctgaggcctccaggatggaggatgccaccaacgtcgtgcgtggcctcatcgttgagctctccaacctgaaccggctgatcatgggcacccaccgggacctggaagctttcaagcgccttaactaccggaagacaaagctgggaggcaaagcccccctgccttacccttccaaggggcctgggaatatccctcgaggggacccaccctggagggagttgtaggccactttgaggtctgtgtttcctttgccacccagcccccatgtccgcagacctcctccaagatgctccagggggtcctagtggaccctacaaacctcccttcagttgcccggaagttggtcttccatggacaacacaaaggaggccgtgaggtcctggcctcacctggccagggtcaaggtcatttgccacccttggcttcagggagggaaactgtgtctcccacagccccagtgacttcaagcgggcctgggctccaggaagctggccacctctgagcagggcccatcctgtccggatttgcaaattttagggtcctgagccaagtatggatggttcagaatttgtttctttcctggaggagaagagagctccctttgttttctttctccccatttccattttatttcttctgggaagacccataataaatgattctgtaga

SEQ ID NO: 291671 - DNA, 633 bp, Homo sapiens
tcttcggagaacttggttatcaaaggccccggggctgagtctttttctgtccacaggaaacaatcgcagagtccagcgcccagagtccaggatgccagctgctagtggagaccctgggggtccccctccaggaggccacggagctgggggacccaacgcaggcagacagtgcccgccctgagcagagcagccagagccctgtgcaggcggtgcccggcagtggggattctcagcctgatgaccctccagacagggggacggggttgtccgcctcacagagggccagccaagaccacctgtcagaacaaggggccgatgacagcaagcctgagacagacagggttccaggtgacggtggccaaaaggaacacctaccaagcattgattctgaaggggagaagccagacagaggagccccccaggagggaggggcccaaaggacagcaggggctggcctgcctggagggccccaggaggagggagacggtgtcccctgtaccccagcatcagctcctacctcaggccctgctccaggactgggccctgcctcttggtgcctggaacccgggtctgtggcccagggctcccctgacccccagcagacccccagcaggatgggtagggaaggggaag

SEQ ID NO: 291672 - DNA, 2701 bp, Homo sapiens
cggcggcggggaggggagaggctctgagaggcgaggccgggtgaggcggcgagggcggcccgacgggcgcgggacgggacggggcagcgagggcgccgggagccgcggcccggaatcggggcgcttcgccccgggccccccagcatgaagaccccggcggacacagggtttgccttcccggattgggcctacaagccagagtcgtcccctggctcaaggcagatccagctgtggcactttatcctggagctgctgcggaaggaggagtaccagggcgtcattgcctggcagggggactacggggaattcgtcatcaaagaccctgatgaggtggcccggctgtggggcgttcgcaagtgcaagccccagatgaattacgacaagctgagccgggccctgcgctattactataacaagcgcattctgcacaagaccaaggggaaacggttcacctacaagttcaatttcaacaaactggtgctggtcaattacccattcattgatgtggggttggctgggggtgcagtgccccagagtgccccgccagtgccgtcgggtggtagccacttccgcttccctccctcaacgccctccgaggtgctgtcccccaccgaggacccccgctcaccaccagcctgctcttcatcttcatcttccctcttctcggctgtggtggcccgccgcctgggccgaggctcagtcagtgactgtagtgatggcacgtcagagctggaggaaccgctgggagaggatccccgcgcccgaccacccggccctccggatctgggtgccttccgagggcccccgctggcccgcctgccccatgaccctggtgtcttccgagtctatccccggcctcggggtggccctgaacccctcagccccttccctgtgtcgcctctggccggtcctggatccctgctgccccctcagctctccccggctctgcccatgacgcccacccacctggcctacactccctcgcccacgctgagcccgatgtaccccagtggtggcggggggcccagcggctcagggggaggctcccacttctccttcagccctgaggacatgaaacggtacctgcaggcccacacccaaagcgtctacaactaccacctcagcccccgcgccttcctgcactaccctgggctggtggtgccccagccccagcgccctgacaagtgcccgctgccgcccatggcacccgagaccccaccggtcccctcctcggcctcgtcatcctcttcttcttcttcctccccattcaagtttaagctccagccgcccccactcggacgccggcagcgggcagctggggagaaggccgtagccggtgctgacaagagcggtggcagtgcaggcgggctggctgagggggcaggggcgctagccccaccgcccccgccaccacagatcaaggtggagcccatctcggaaggcgagtcggaggaggtagaggtgactgacatcagtgatgaggatgaggaagacggggaggtgttcaagacgccccgtgccccacctgcaccccctaagcctgagcccggcgaggcacccggggcatcccagtgcatgcccctcaagctacgctttaagcggcgctggagtgaagactgtcgcctcgaagggggtgggggccccgctgggggctttgaggatgagggtgaggacaagaaggtgcgtggggaggggcctggggaggctggggggcccctcaccccaaggcgggtgagctctgacctccagcatgccacggcccagctctccctggagcaccgagactcctgagggctgtgggcaggggacctgtgtgccccgcaccccccatgcttcttttgctgccttaagccccctatgccctggaggtgagggcagctctcttgtctcttccctgcctcctcccttttccctccccacattttgtataaaactttaatttcttttttttaaaaatggtgggggtgggtgggtgcccagggctaggggctattccctgtctctgtgggtttctaagctctgggcaaagtggtggtagggggagggagggggaagttaagggggtcacctccattctggggaatttatatttgaattgaggctttggccttaacacccaggaacttttctattacaatcgcttaggaagtaaagccttgtctccctccctgttctctgcctcttgtacccctctgacccacccgctctgccccactcccagccctcctcagccccagccctgcctgccctgcccctccagggggccatgagtgcctaggtttctcataccccacaaggtcacagcaggggagggagggacaattttataatgaaccaaaaattccatgtgttggggggtggggggcggaggagggtgaggggtgccgcccatgggccacaaatctctacaagtgcctgctatccctctcccactccccaccccagcaccggtccaaccccttcatccccagctgctcctaggactggcccatgggcaggcgggtggggggatgggaagggggtgccctgaaaccaaactggaagccccctctgcctcccagctggggcctctggggtggggtggggggctgtggtcaagccttattctgtattggggactgagggtggggggagtagaggggccgctggagaatgtattcaaaacaataaaactttggacctttggatgcagtgatcaatg

SEQ ID NO: 291673 - DNA, 2593 bp, Homo sapiens
gtttccttcccccggcggcggcggcggcggcggcggcggctcgggctcctgtgtgcggggtttgccttcccggattgggcctacaagccagagtcgtcccctggctcaaggcagatccagctgtggcactttatcctggagctgctgcggaaggaggagtaccagggcgtcattgcctggcagggggactacggggaattcgtcatcaaagaccctgatgaggtggcccggctgtggggcgttcgcaagtgcaagccccagatgaattacgacaagctgagccgggccctgcgctattactataacaagcgcattctgcacaagaccaaggggaaacggttcacctacaagttcaatttcaacaaactggtgctggtcaattacccattcattgatgtggggttggctgggggtgcagtgccccagagtgccccgccagtgccgtcgggtggtagccacttccgcttccctccctcaacgccctccgaggtgctgtcccccaccgaggacccccgctcaccaccagcctgctcttcatcttcatcttccctcttctcggctgtggtggcccgccgcctgggccgaggctcagtcagtgactgtagtgatggcacgtcagagctggaggaaccgctgggagaggatccccgcgcccgaccacccggccctccggatctgggtgccttccgagggcccccgctggcccgcctgccccatgaccctggtgtcttccgagtctatccccggcctcggggtggccctgaacccctcagccccttccctgtgtcgcctctggccggtcctggatccctgctgccccctcagctctccccggctctgcccatgacgcccacccacctggcctacactccctcgcccacgctgagcccgatgtaccccagtggtggcggggggcccagcggctcagggggaggctcccacttctccttcagccctgaggacatgaaacggtacctgcaggcccacacccaaagcgtctacaactaccacctcagcccccgcgccttcctgcactaccctgggctggtggtgccccagccccagcgccctgacaagtgcccgctgccgcccatggcacccgagaccccaccggtcccctcctcggcctcgtcatcctcttcttcttcttcctccccattcaagtttaagctccagccgcccccactcggacgccggcagcgggcagctggggagaaggccgtagccggtgctgacaagagcggtggcagtgcaggcgggctggctgagggggcaggggcgctagccccaccgcccccgccaccacagatcaaggtggagcccatctcggaaggcgagtcggaggaggtagaggtgactgacatcagtgatgaggatgaggaagacggggaggtgttcaagacgccccgtgccccacctgcaccccctaagcctgagcccggcgaggcacccggggcatcccagtgcatgcccctcaagctacgctttaagcggcgctggagtgaagactgtcgcctcgaagggggtgggggccccgctgggggctttgaggatgagggtgaggacaagaaggtgcgtggggaggggcctggggaggctggggggcccctcaccccaaggcgggtgagctctgacctccagcatgccacggcccagctctccctggagcaccgagactcctgagggctgtgggcaggggacctgtgtgccccgcaccccccatgcttcttttgctgccttaagccccctatgccctggaggtgagggcagctctcttgtctcttccctgcctcctcccttttccctccccacattttgtataaaactttaatttcttttttttaaaaatggtgggggtgggtgggtgcccagggctaggggctattccctgtctctgtgggtttctaagctctgggcaaagtggtggtagggggagggagggggaagttaagggggtcacctccattctggggaatttatatttgaattgaggctttggccttaacacccaggaacttttctattacaatcgcttaggaagtaaagccttgtctccctccctgttctctgcctcttgtacccctctgacccacccgctctgccccactcccagccctcctcagccccagccctgcctgccctgcccctccagggggccatgagtgcctaggtttctcataccccacaaggtcacagcaggggagggagggacaattttataatgaaccaaaaattccatgtgttggggggtggggggcggaggagggtgaggggtgccgcccatgggccacaaatctctacaagtgcctgctatccctctcccactccccaccccagcaccggtccaaccccttcatccccagctgctcctaggactggcccatgggcaggcgggtggggggatgggaagggggtgccctgaaaccaaactggaagccccctctgcctcccagctggggcctctggggtggggtggggggctgtggtcaagccttattctgtattggggactgagggtggggggagtagaggggccgctggagaatgtattcaaaacaataaaactttggacctttggatgcagtgatcaatg

SEQ ID NO: 291674 - DNA, 2348 bp, Homo sapiens
tacccggctggttacgggggaagggagtcttccactggccgttgaagtagagggcattcaccagcaccagccgtgtcagctggtccacggctcctttcccaagcaagttgctgatcataccttttgtgtgtgtcttcacccagtcattgatgatgggttggctgggggtgcagtgccccagagtgccccgccagtgccgtcgggtggtagccacttccgcttccctccctcaacgccctccgaggtgctgtcccccaccgaggacccccgctcaccaccagcctgctcttcatcttcatcttccctcttctcggctgtggtggcccgccgcctgggccgaggctcagtcagtgactgtagtgatggcacgtcagagctggaggaaccgctgggagaggatccccgcgcccgaccacccggccctccggatctgggtgccttccgagggcccccgctggcccgcctgccccatgaccctggtgtcttccgagtctatccccggcctcggggtggccctgaacccctcagccccttccctgtgtcgcctctggccggtcctggatccctgctgccccctcagctctccccggctctgcccatgacgcccacccacctggcctacactccctcgcccacgctgagcccgatgtaccccagtggtggcggggggcccagcggctcagggggaggctcccacttctccttcagccctgaggacatgaaacggtacctgcaggcccacacccaaagcgtctacaactaccacctcagcccccgcgccttcctgcactaccctgggctggtggtgccccagccccagcgccctgacaagtgcccgctgccgcccatggcacccgagaccccaccggtcccctcctcggcctcgtcatcctcttcttcttcttcctccccattcaagtttaagctccagccgcccccactcggacgccggcagcgggcagctggggagaaggccgtagccggtgctgacaagagcggtggcagtgcaggcgggctggctgagggggcaggggcgctagccccaccgcccccgccaccacagatcaaggtggagcccatctcggaaggcgagtcggaggaggtagaggtgactgacatcagtgatgaggatgaggaagacggggaggtgttcaagacgccccgtgccccacctgcaccccctaagcctgagcccggcgaggcacccggggcatcccagtgcatgcccctcaagctacgctttaagcggcgctggagtgaagactgtcgcctcgaagggggtgggggccccgctgggggctttgaggatgagggtgaggacaagaaggtgcgtggggaggggcctggggaggctggggggcccctcaccccaaggcgggtgagctctgacctccagcatgccacggcccagctctccctggagcaccgagactcctgagggctgtgggcaggggacctgtgtgccccgcaccccccatgcttcttttgctgccttaagccccctatgccctggaggtgagggcagctctcttgtctcttccctgcctcctcccttttccctccccacattttgtataaaactttaatttcttttttttaaaaatggtgggggtgggtgggtgcccagggctaggggctattccctgtctctgtgggtttctaagctctgggcaaagtggtggtagggggagggagggggaagttaagggggtcacctccattctggggaatttatatttgaattgaggctttggccttaacacccaggaacttttctattacaatcgcttaggaagtaaagccttgtctccctccctgttctctgcctcttgtacccctctgacccacccgctctgccccactcccagccctcctcagccccagccctgcctgccctgcccctccagggggccatgagtgcctaggtttctcataccccacaaggtcacagcaggggagggagggacaattttataatgaaccaaaaattccatgtgttggggggtggggggcggaggagggtgaggggtgccgcccatgggccacaaatctctacaagtgcctgctatccctctcccactccccaccccagcaccggtccaaccccttcatccccagctgctcctaggactggcccatgggcaggcgggtggggggatgggaagggggtgccctgaaaccaaactggaagccccctctgcctcccagctggggcctctggggtggggtggggggctgtggtcaagccttattctgtattggggactgagggtggggggagtagaggggccgctggagaatgtattcaaaacaataaaactttggacctttggatgcagtgatcaatg

SEQ ID NO: 291675 - DNA, 1960 bp, Homo sapiens
cggcggcggggaggggagaggctctgagagggccctccggatctgggtgccttccgagggcccccgctggcccgcctgccccatgaccctggtgtcttccgagtctatccccggcctcggggtggccctgaacccctcagccccttccctgtgtcgcctctggccggtcctggatccctgctgccccctcagctctccccggctctgcccatgacgcccacccacctggcctacactccctcgcccacgctgagcccgatgtaccccagtggtggcggggggcccagcggctcagggggaggctcccacttctccttcagccctgaggacatgaaacggtacctgcaggcccacacccaaagcgtctacaactaccacctcagcccccgcgccttcctgcactaccctgggctggtggtgccccagccccagcgccctgacaagtgcccgctgccgcccatggcacccgagaccccaccggtcccctcctcggcctcgtcatcctcttcttcttcttcctccccattcaagtttaagctccagccgcccccactcggacgccggcagcgggcagctggggagaaggccgtagccggtgctgacaagagcggtggcagtgcaggcgggctggctgagggggcaggggcgctagccccaccgcccccgccaccacagatcaaggtggagcccatctcggaaggcgagtcggaggaggtagaggtgactgacatcagtgatgaggatgaggaagacggggaggtgttcaagacgccccgtgccccacctgcaccccctaagcctgagcccggcgaggcacccggggcatcccagtgcatgcccctcaagctacgctttaagcggcgctggagtgaagactgtcgcctcgaagggggtgggggccccgctgggggctttgaggatgagggtgaggacaagaaggtgcgtggggaggggcctggggaggctggggggcccctcaccccaaggcgggtgagctctgacctccagcatgccacggcccagctctccctggagcaccgagactcctgagggctgtgggcaggggacctgtgtgccccgcaccccccatgcttcttttgctgccttaagccccctatgccctggaggtgagggcagctctcttgtctcttccctgcctcctcccttttccctccccacattttgtataaaactttaatttcttttttttaaaaatggtgggggtgggtgggtgcccagggctaggggctattccctgtctctgtgggtttctaagctctgggcaaagtggtggtagggggagggagggggaagttaagggggtcacctccattctggggaatttatatttgaattgaggctttggccttaacacccaggaacttttctattacaatcgcttaggaagtaaagccttgtctccctccctgttctctgcctcttgtacccctctgacccacccgctctgccccactcccagccctcctcagccccagccctgcctgccctgcccctccagggggccatgagtgcctaggtttctcataccccacaaggtcacagcaggggagggagggacaattttataatgaaccaaaaattccatgtgttggggggtggggggcggaggagggtgaggggtgccgcccatgggccacaaatctctacaagtgcctgctatccctctcccactccccaccccagcaccggtccaaccccttcatccccagctgctcctaggactggcccatgggcaggcgggtggggggatgggaagggggtgccctgaaaccaaactggaagccccctctgcctcccagctggggcctctggggtggggtggggggctgtggtcaagccttattctgtattggggactgagggtggggggagtagaggggccgctggagaatgtattcaaaacaataaaactttggacctttggatgcagtgatcaatg

SEQ ID NO: 291676 - DNA, 2571 bp, Homo sapiens
cggcggcggggaggggagaggctctgagaggcgaggccgggtgaggcggcgagggcggcccgacgggcgcgggacgggacggggcagcgagggcgccgggagccgcggcccggaatcggggcgcttcgccccgggccccccagcatgaagaccccggcggacacagggtttgccttcccggattgggcctacaagccagagtcgtcccctggctcaaggcagatccagctgtggcactttatcctggagctgctgcggaaggaggagtaccagggcgtcattgcctggcagggggactacggggaattcgtcatcaaagaccctgatgaggtggcccggctgtggggcgttcgcaagtgcaagccccagatgaattacgacaagctgagccgggccctgcgctattactataacaagcgcattctgcacaagaccaaggggaaacggttcacctacaagttcaatttcaacaaactggtgctggtcaattacccattcattgatgtggggttggctgggggtgcagtgccccagagtgccccgccagtgccgtcgggtggtagccacttccgcttccctccctcaacgccctccgaggtgctgtcccccaccgaggacccccgctcaccaccagcctgctcttcatcttcatcttccctcttctcggctgtggtggcccgccgcctgggccgaggctcagtcagtgactgtagtgatggcacgtcagagctggaggaaccgctgggagaggatccccgcgcccgaccacccggccctccggatctgggtgccttccgagggcccccgctggcccgcctgccccatgaccctggtgtcttccgagtctatccccggcctcggggtggccctgaacccctcagccccttccctgtgtcgcctctggccggtcctggatccctgctgccccctcagctctccccggctctgcccatgacgcccacccacctggcctacactccctcgcccacgctgagcccgatgtaccccagtggtggcggggggcccagcggctcagggggaggctcccacttctccttcagccctgaggacatgaaacggtacctgcaggcccacacccaaagcgtctacaactaccacctcagcccccgcgccttcctgcactaccctgggctggtggtgccccagccccagcgccctgacaagtgcccgctgccgcccatggcacccgagaccccaccggtcccctcctcggcctcgtcatcctcttcttcttcttcctccccattcaagtttaagctccagccgcccccactcggacgccggcagcgggcagctggggagaaggccgtagccggtgctgacaagagcggtggcagtgcaggcgggctggctgagggggcaggggcgctagccccaccgcccccgccaccacagatcaaggtggagcccatctcggaaggcgagtcggaggaggtagaggtgactgacatcagtgatgaggatgaggaagacggggaggtgttcaagacgccccgtgccccacctgcaccccctaagcctgagcccggcgaggcacccggggcatcccagtgcatgcccctcaagctacgctttaagcggcgctggagtgaagactgtcgcctcgaagggggtgggggccccgctgggggctttgaggatgagggtgaggacaagaaggtgcgtggggaggggcctggggaggctggggggcccctcaccccaaggcgggtgagctctgacctccagcatgccacggcccagctctccctggagcaccgagactcctgagggctgtgggcaggggacctgtgtgccccgcaccccccatgcttcttttgctgccttaagccccctatgccctggaggtgagggcagctctcttgtctcttccctgcctcctcccttttccctccccacattttgtataaaactttaatttcttttttttaaaaatggtgggggtgggtgggtgcccagggctaggggctattccctgtctctgtgggtttctaagctctgggcaaagtggtggtagggggagggagggggaagttaagggggtcacctccattctggggaatttatatttgaattgaggctttggccttaacacccaggaacttttctattacaatcgcttaggaagtaaagccttgtctccctccctgttctctgcctcttgtacccctctgacccacccgctctgccccactcccagccctcctcagccccagccctgcctgccctgcccctccagggggccatgagtgcctaggtttctcataccccacaaggtcacagcaggggagggagggacaattttataatgaaccaaaaattccatgtgttggggggtggggggcggaggagggtgaggggtgccgcccatgggccacaaatctctacaagtgcctgctatccctctcccactccccaccccagcaccggtggggggctgtggtcaagccttattctgtattggggactgagggtggggggagtagaggggccgctggagaatgtattcaaaacaataaaactttggacctttggatgcagtgatcaatg

SEQ ID NO: 291677 - DNA, 2503 bp, Homo sapiens
cggcggcggggaggggagaggctctgagaggcgaggccgggtgaggcggcgagggcggcccgacgggcgcgggacgggacggggcagcgagggcgccgggagccgcggcccggaatcggggcgcttcgccccgggccccccagcatgaagaccccggcggacacagggtttgccttcccggattgggcctacaagccagagtcgtcccctggctcaaggcagatccagctgtggcactttatcctggagctgctgcggaaggaggagtaccagggcgtcattgcctggcagggggactacggggaattcgtcatcaaagaccctgatgaggtggcccggctgtggggcgttcgcaagtgcaagccccagatgaattacgacaagctgagccgggccctgcgctattactataacaagcgcattctgcacaagaccaaggggaaacggttcacctacaagttcaatttcaacaaactggtgctggtcaattacccattcattgatgtggggttggctgggggtgcagtgccccagagtgccccgccagtgccgtcgggtggtagccacttccgcttccctccctcaacgccctccgaggtgctgtcccccaccgaggacccccgctcaccaccagcctgctcttcatcttcatcttccctcttctcggctgtggtggcccgccgcctgggccgaggctcagtcagtgactgtagtgatggcacgtcagagctggaggaaccgctgggagaggatccccgcgcccgaccacccggccctccggatctgggtgccttccgagggcccccgctggcccgcctgccccatgaccctggtgtcttccgagtctatccccggcctcggggtggccctgaacccctcagccccttccctgtgtcgcctctggccggtcctggatccctgctgccccctcagctctccccggctctgcccatgacgcccacccacctggcctacactccctcgcccacgctgagcccgatgtaccccagtggtggcggggggcccagcggctcagggggaggctcccacttctccttcagccctgaggacatgaaacggtacctgcaggcccacacccaaagcgtctacaactaccacctcagcccccgcgccttcctgcactaccctgggctggtggtgccccagccccagcgccctgacaagtgcccgctgccgcccatggcacccgagaccccaccggtcccctcctcggcctcgtcatcctcttcttcttcttcctccccattcaagtttaagctccagccgcccccactcggacgccggcagcgggcagctggggagaaggccgtagccggtgctgacaagagcggtggcagtgcaggcgggctggctgagggggcaggggcgctagccccaccgcccccgccaccacagatcaaggtggagcccatctcggaaggcgagtcggaggaggtagaggtgactgacatcagtgatgaggatgaggaagacggggaggtgttcaagacgccccgtgccccacctgcaccccctaagcctgagcccggcgaggcacccggggcatcccagtgcatgcccctcaagctacgctttaagcggcgctggagtgaagactgtcgcctcgaagggggtgggggccccgctgggggctttgaggatgagggtgaggacaagaaggtgcgtggggaggggcctggggaggctggggggcccctcaccccaaggcgggtgagctctgacctccagcatgccacggcccagctctccctggagcaccgagactcctgagggctgtgggcaggggacctgtgtgccccgcaccccccatgcttcttttgctgccttaagccccctatgccctggaggtgagggcagctctcttgtctcttccctgcctcctcccttttccctccccacattttgtataaaactttaatttcttttttttaaaaatggtgggggtgggtgggtgcccagggctaggggctattccctgtctctgtgggtttctaagctctgggcaaagtggtggtagggggagggagggggaagttaagggggtcacctccattctggggaatttatatttgaattgaggctttggccttaacacccaggaacttttctattacaatcgcttaggaagtaaagccttgtctccctccctgttctctgcctcttgtacccctctgacccacccgctctgccccactcccagccctcctcagccccagccctgcctgccctgcccctccagggggccatgagtgcctaggtttctcataccccacaaggtcacagcaggggagggagggacaattttataatgaaccaaactggaagccccctctgcctcccagctggggcctctggggtggggtggggggctgtggtcaagccttattctgtattggggactgagggtggggggagtagaggggccgctggagaatgtattcaaaacaataaaactttggacctttggatgcagtgatcaatg

SEQ ID NO: 291678 - DNA, 2407 bp, Homo sapiens
  misc_feature (2407)..(2407): n is a, c, g, or t
cggcggcggggaggggagaggctctgagaggcgaggccgggtgaggcggcgagggcggcccgacgggcgcgggacgggacggggcagcgagggcgccgggagccgcggcccggaatcggggcgcttcgccccgggccccccagcatgaagaccccggcggacacagggtttgccttcccggattgggcctacaagccagagtcgtcccctggctcaaggcagatccagctgtggcactttatcctggagctgctgcggaaggaggagtaccagggcgtcattgcctggcagggggactacggggaattcgtcatcaaagaccctgatgaggtggcccggctgtggggcgttcgcaagtgcaagccccagatgaattacgacaagctgagccgggccctgcgctattactataacaagcgcattctgcacaagaccaaggggaaacggttcacctacaagttcaatttcaacaaactggtgctggtcaattacccattcattgatgtggggttggctgggggtgcagtgccccagagtgccccgccagtgccgtcgggtggtagccacttccgcttccctccctcaacgccctccgaggtgctgtcccccaccgaggacccccgctcaccaccagcctgctcttcatcttcatcttccctcttctcggctgtggtggcccgccgcctgggccgaggctcagtcagtgactgtagtgatggcacgtcagagctggaggaaccgctgggagaggatccccgcgcccgaccacccggccctccggatctgggtgccttccgagggcccccgctggcccgcctgccccatgaccctggtgtcttccgagtctatccccggcctcggggtggccctgaacccctcagccccttccctgtgtcgcctctggccggtcctggatccctgctgccccctcagctctccccggctctgcccatgacgcccacccacctggcctacactccctcgcccacgctgagcccgatgtaccccagtggtggcggggggcccagcggctcagggggaggctcccacttctccttcagccctgaggacatgaaacggtacctgcaggcccacacccaaagcgtctacaactaccacctcagcccccgcgccttcctgcactaccctgggctggtggtgccccagccccagcgccctgacaagtgcccgctgccgcccatggcacccgagaccccaccggtcccctcctcggcctcgtcatcctcttcttcttcttcctccccattcaagtttaagctccagccgcccccactcggacgccggcagcgggcagctggggagaaggccgtagccggtgctgacaagagcggtggcagtgcaggcgggctggctgagggggcaggggcgctagccccaccgcccccgccaccacagatcaaggtggagcccatctcggaaggcgagtcggaggaggtagaggtgactgacatcagtgatgaggatgaggaagacggggaggtgttcaagacgccccgtgccccacctgcaccccctaagcctgagcccggcgaggcacccggggcatcccagtgcatgcccctcaagctacgctttaagcggcgctggagtgaagactgtcgcctcgaagggggtgggggccccgctgggggctttgaggatgagggtgaggacaagaaggtgcgtggggaggggcctggggaggctggggggcccctcaccccaaggcgggtgagctctgacctccagcatgccacggcccagctctccctggagcaccgagactcctgagggctgtgggcaggggacctgtgtgccccgcaccccccatgcttcttttgctgccttaagccccctatgcccttccctgtgtcgcctctggccggtcctggatccctgctgccccctcagctctccccggctctgcccatgacgcccacagttattgtataacacactcttaactaacataaaagattaaacaatggtcgggcggctggagctagggtgcccacgggactaggcggcatatttccccatcgtactcgtgtagagcgatctctctacagcctgcttggcgacaaacagttggatgcgctagacggacggacagagggcagagtgcggaagaggctttcacagcgcgcgttctccccctcgcgaattccatgcggccggaccatcccatacttgcgcgccatttgcaggccattctggggagcttttaaggaacgcccgatgggaaagcttttctgctaagttaacagaatccgggattacgggaacggttaagaggacctactgtcgcttccccatcaccctgtggttacagtcatggcgcttctcttgtaacggcccctcatggaacgccaacccgggatcactggccccagacgcacctcggacn

SEQ ID NO: 291679 - DNA, 1503 bp, Homo sapiens
cggcggcggggaggggagaggctctgagaggcgaggccgggtgaggcggcgagggcggcccgacgggcgcgggacgggacggggcagcgagggcgccgggagccgcggcccggaatcggggcgcttcgccccgggccccccagcatgaagaccccggcggacacagggtttgccttcccggattgggcctacaagccagagtcgtcccctggctcaaggcagatccagctgtggcactttatcctggagctgctgcggaaggaggagtaccagggcgtcattgcctggcagggggactacggggaattcgtcatcaaagaccctgatgaggtggcccggctgtggggcgttcgcaagtgcaagccccagatgaattacgacaagctgagccgggccctgcgctattactataacaagcgcattctgcacaagaccaaggggaaacggttcacctacaagttcaatttcaacaaactggtgctggtcaattacccattcattgatgtggggttggctgggggtgcagtgccccagagtgccccgccagtgccgtcgggtggtagccacttccgcttccctccctcaacgccctccgaggtgctgtcccccaccgaggacccccgctcaccaccagcctgctcttcatcttcatcttccctcttctcggctgtggtggcccgccgcctgggccgaggctcagtcagtgactgtagtgatggcacgtcagagctggaggaaccgctgggagaggatccccgcgcccgaccacccggccctccggatctgggtgccttccgagggcccccgctggcccgcctgccccatgaccctggtgtcttccgagtctatccccggcctcggggtggccctgaacccctcagccccttccctgtgtcgcctctggccggtcctggatccctgctgccccctcagctctccccggctctgcccatgacgcccacccacctggcctacactccctcgcccacgctgagcccgatgtaccccagtggtggcggggggcccagcggctcagggggaggctcccacttctccttcagccctgaggacatgaaacggtacctgcaggcccacacccaaagcgtctacaactaccacctcagcccccgcgccttcctgcactaccctgggctggtggtgccccagccccagcgccctgacaagtgcccgctgccgcccatggcacccgagaccccaccggtcccctcctcggcctcgtcatcctcttcttcttcttcctccccattcaagtttaagctccagccgcccccatgggcaggcgggtggggggatgggaagggggtgccctgaaaccaaactggaagccccctctgcctcccagctggggcctctggggtggggtggggggctgtggtcaagccttattctgtattggggactgagggtggggggagtagaggggccgctggagaatgtattcaaaacaataaaactttggacctttggatgcagtgatcaatg

SEQ ID NO: 291680 - DNA, 602 bp, Homo sapiens
gccgggacatcagtcttctcctgcctttggactctggacttacaccatcagctctactggttctcaggcctttggactcgaactggaactacaccattggctctcctgggtctccagcttggcaactgcaggtcttgggacttgtcagcctccacaatgatgtgtgtttcggcagatgagaccacaggcgctggccatgctgtacttccacctgtgccctggctgcaccatgtggcatgatgaggctgcggagggcgttttccggcagctgggtgtgaggccccgatgctggaattctacagccatgatgacccctcaacaatgctgcctggctgcaggagttgctgagtggcttgcagtaggtgaagcctgggagacctcctgacatggggcccacctgcaccagcacacccccaccccacccccagtacctcaacaccctcaaaccttcctggggaggcagggcctggtgccataccccccagcccaactctgatggggctccagccacccaatggacagggcatacagacaggatagtggaggcgttgagacctgcttgatttattccaagtatttaatacacaatgacgcaactgtga

SEQ ID NO: 291681 - DNA, 2564 bp, Homo sapiens
gaattcgggccggagccagcagtggcaacccgctggggtccctttccacactgtggaagctttgttctttcgctctttgcaataaatcttgctacttctcactctttgggtccacactgcttttaccagctgtaacactcaccgcaaacgtctgcagcttcactcctgaagccagcgagaccacgagcccaccgggaggaacgaacaactccagacgcgccgccttaagccttaagagctgtaacactcaccacgaaggtctgcagcttcactcctgagccagcgagaccacgaacccgccagaaggaagaaactccgaacacatccgaacatcagaaggaacaaactctagacgcgccaccttaagagctgtaacactcaccacaagggtccgcggcttcattcttgaagtcagtgagaccaagaacccaccaattccggacacagttggaaatgcagaagggcacttgagtttccctgcagtctcccacacggacaccttctggaggaagatgagccctaaacgcgatgggttggggacaggtgatggtctgcactcacaggttttacaggagcaggtctccacaggagacaatctccatgaatgtgactcccagggaccaagtaaagacactttggttcgtgaggggaagacctacaaatgcaaggaatgtgggagcgtgtttaacaaaaacagcctccttgttcgacatcagcagattcacactggggtgaagccttatgaatgccaggagtgtggaaaagcctttcctgaaaaggtcgacttcgttcgacacatgaggattcacacaggggagaagccctgtaagtgcgtggagtgcgggaaggtcttcaaccgcaggtcgcacctcctgtgctaccgccagattcacactggagagaagccctatgagtgcagcgagtgtggaaagaccttcagctatcactctgtcttcatccagcatcgtgtgacccacactggagaaaaactctttgggtgcaaagaatgtggaaaaaccttttactacaactcttccttaacccggcacatgaagattcacactggagagaagccctgcaagtgcagtgagtgcgggaagaccttcacctaccgctctgttttcttccgacatagtatgacccacactgcaggaaagccctacgagtgcaaagaatgtgggaaaggtttttactacagctattccctcactcgacatacaaggagtcacactggagagaaaccttatgagtgccttgaacatagaaaggactttggctaccactctgcttttgcccaacagagtaagatccactctggaggaaaaaacctttgagtgcaaatgatgtgggaatttgtgggttttctttttttttttttctttgatacatagagagccacactgaggagaagcactctgaattcagtggcagtaggaaagctgtgacctgcagctcatcctcacttggcattgaagaattccttccagagataaactctatgagatatgtgggaaggccttttgcaagtgggcccacatcagtcaacgtcagagaacttaaactgcgaaaagacattttgacaaaaactagtgaagaaaatcttttggccacaggaaatatcttcctcagcatctgagaatttttccaggagggagacctgttggttattgtgcacttaaaagaaccacccacacctctctccatagtttatatcactaagccacttcaggattttttttttttaagtaagaagggaactgtaaaagagaaaaaaagaaattcatgcatagcttctgtcagacttctctgaaagaaatgcctatcaaaatttgaattcagttcttcattttgcagatggctgaaagggacgagagaatgatggtgaagctgtgttgctttcccaggtgagccttgattatttcctctgtgctttctcagcttctttggccttctgtaagaggggcttctccaagagcatgtcactagttttctagaagttaaacaagagctaagacaaacaaaacaaaacacagcttatctaatctaatgagaaactcagaaaaaaatgttttgatgaatacaatgtattaaaatataaaacatgtagatcctttgacatgttaattcaattctagaaatcctcagaaatgtttttatattatgcagagatgtgcgtgcaaagaataatcgctgcagttttgtttttatgtgtgaaacgttgagaacaatctaaatgtttatcagttggaagtaagttatggtacatctgttctatgaaatactgtgaaacaataaggtatctctgtatgtactgatatcaaaacatctctaagatacagtatttagtaaaagagaaagtttcaggaaataaaactacatctagaagtataagcataaaactgttaatagtggttttctgcaggaaatgggatggaccagggttatatgcaatgttcagtttttacttttatacttaagtattgtttatgtttgaaaaataaaaagcatttattgtttttgcaataaatgtttaaaatatttcaataaagatagcatgttagaat

SEQ ID NO: 291682 - DNA, 458 bp, Homo sapiens
atcccagagtttcactcctgttgcccaggctggaatgcaatggcacaatctgggctcgctgcaacctccacctcctgggttccagtgattgtcctgccagcctccagagtagctgggattacaggcgtgggcaaccacagtcagcctttttactttcttgatactgttgctggatgtacaaaagtttttaaatttgatgaagtctagtttatctttttcttttgttgtccttgcttttgatgtcatacttaaaacattgccagatgcagcatcatgaagattttcccatatgttttcttctaggagttttatagctttagctcataagtttgtctttgatccactttgagttgatttttatatatgatgtaaggtaagggtttgatttcattcttttgcatatagctgtctattttttgcagactgtcctttcctctagtgaatgatccggccctttt

SEQ ID NO: 291683 - DNA, 1391 bp, Homo sapiens
  misc_feature (12)..(12): n is a, c, g, or t
  misc_feature (300)..(300): n is a, c, g, or t
atggatttaccngtgaacctaacctccttttccctctccaccccctcccctttggagaccaaccacagcctcggcaaagacgacctgcgccccagctcgcccctgctctcggtcttcggagtgcttattctcaccttgctgggctttctggtggcggcgacgttcgcctggaacctgctggtgctggcgaccatcctccgtgtacgcaccttccaccgcgtgccccacaacctggtggcatccatggccgtctcggatgtcctggtggccgcgctggtcatgccgctgagcctggtgcangagctgtccgggcgccgctggcagctaggtcggaggctgtgccagctttggatcgcgtgcgacgtgctttgctgcacggccagcatctggaacgtgacggccatagccctggaccgctactggtccatcacgcgccacatggaatacacgctccgcacccgcaagtgcgtctccaacgtcatgatcgcgctcacctgggcactctccgctgtcatctctctggccccgctgctttttggctggggagagacgtactctgagggcagcgaggagtgccaggtaagccgcgagccttcctacgccgtgttctccaccgtaggcgccttctacctgccgctctgtgtggtgctcttcgtgtactggaagatctacaaggctgccaagttccgcgtgggctccaggaagaccaatagcgtctcacccatatccgaagctgtggaggtgaaggactctgccaaacagccccagatggtgttcacggtccgccacgccaccgtcaccttccagccagaaggggacacgtggcgggagcagaaggagcagcgggccgccctcatggtgggcatcctcattggcgtgttcgtgctctgctggatccccttctttctcaccgagctcatcagtcccctctgctcctgtgacatccccgccatctggaaaagcatcttcctgtggcttggctactccaactccttctttaaccccctgatctatacggctttcaacaagaactacaacagcgccttcaagaacttcttttctaggcaacactgagggagaggaccaggattgaaaaaagtttcttcccataattcagtggaattcccagttcatccatttcccatccccacccaacagccatgtggacgggatgaatcctcaccattctccagggtcatcttcagaactgcactggcctcttttccacctcctcagtaggaatatgactcctcatagagttacggtgacatgatgtatctaacttatctactatccctttctctgtgctgacagtcatggtctttgcccgcaaagtgtcctttcctccccaaattcactctggcatggtgatcgacattgtcttaaagaag

SEQ ID NO: 291684 - DNA, 948 bp, Homo sapiens
  misc_feature (136)..(136): n is a, c, g, or t
ggtcgtaggctcttgttcgtgtctgtctttgtgcgctgtgatctatgttgcctctgtgtcaagtgttgctacacatgagcgagcaagacacgagcagtaaatacgccctctcctaccacggcataagtgggcttcnctgtgtgcagccgtatcctttgtaaacttggatcttaaagttctagtactatggtctccctcgacgccttctagtatatcccgccccccactgttccgaccactcacctgtcgaattcggccaggctcccgattcaacaccatctacaggttcagactgcaacagccaattcaagcatttccctcccgttcagaatcccttgccctaaagcagcctgaacccggattgctcacacttgcttctcgccaaatatgagagtgttggataaatgggatcatgcagcatgcaagattttgaaactgccggccagacgcgatggctcacgcctgtaatcccagcactttgggaggctgagacaggcggatcacgaggactaaaggaccacacaagaattccttacagtagaagccaggcctgggagcattacacaaagcaccccctaagaccagatgaaacagtgatggctgctgcccttgcactcaatgagatggaccaatatgtcatttgtagggccacaattgtgaggccattcattaggagaagctcaccagtttgatgcctgagaggacctccaacagagagatcaggttatggccatcccgcagatcttcataaagatcattgatgtgcttgcggacctgtgaatgagagtgaaacagacagatttttatttgatattgaattattatactatccacataaaaatctctggttctaggtaaacacaaattaaagaatttaaaagtggaagcaacaattaaataataaaattcaggaagtttcagattggaataaaatacatgtgaaatgat

SEQ ID NO: 291685 - DNA, 723 bp, Homo sapiens
atcagtattcatgtggaacattggcctgtagttttcttattttgatgtctctgtctgattttggtatcagggtaatactggcctcacagaatgaaatgctttgatgtcttaaatggtacatccaaacttaagtgaaatagagctgtgaggacattttggggagaagtgacctagataagcactgactgttgcattcatctctcttcttgctgattgtgatgatttcctgtgccatagccattcaaagtctgccaaaaagagatgggattttgccatgttgcctaggctggtctcaaactcctgagctcaagtgatctgtccaccttggccttcctgtgattacaggtgtgagccactgtgcccaccaactgaccattacatctttatggttttcttccaaaagcaatctgaagaattttgggattacagcttttattgttattaaggtatagcttatgcattaaataatttcttctttcaaaacaccacaccaagcgacacccacacacaagacacattgtgcggccgcaccgggccctcagaaaaatttcgaaaaccacttcgtggggccgacgccgccccaggggtcacggtcaatcgggcacaggcggtcccaagaagaccgcgcagcacaaggccgggatccccccaaaaaaccgcccgggagccgcgtcgcaccacacagagggtcgaggacacggtctcacaggccaaggcgataac

SEQ ID NO: 291686 - DNA, 1294 bp, Homo sapiens
agagaggcgctatgcctccctgccggcgacacgatacagcgctgcagaaccgaccccgacgcagccgccatcgctgatgccactgccagtcatgcggttccgcccctgcgttgccgcgcggggccgcgcacgcaaatacgcaggcacgcgcgggagcacgcccgggagcgcgcatgcgcagcgctgctggcccgctctctgaggagctttcaatactttggggtcaagtttgaggcagttgtaactgtactgagtttagttttgctaataatggtattctacgtgtgtcagcctcgtgtggacttctgtaatgactaatggatatgtttatatcctgagcatttgctgtaggaattttaaatgcaatcccaaaactcaagattaccttatttggagaaatattcgtgttactatgtttaaaatttaatagaaccatattttacctttcactttgggactcgcacaggatgtttgcagctcttgatatacaggaactagaacgtgtcttttaagagcatgcggttttataattacgtggaagtatgctacgcaagggaaaaaagcctcttgctagtgttaagggtcttcataaacagaaaccgcaaggaacctgggatctgacagctgttggaggaatgcctgtgaggaaggaggaggaacagaagaatgctttgatgtcttaaatggtacatccaaacttaagtgaaatagagctgtgaggacattttggggagaagtgacctagataagcactgactgttgcattcatctctcttcttgctgattgtgatgatttcctgtgccatagccattcaaagtctgccaaaaagagatgggattttgccatgttgcctaggctggtctcaaactcctgagctcaagtgatctgtccaccttggccttcctgtgattacaggtgtgagccactgtgcccaccaactgaccattacatctttatggttttcttccaaaagcaatctgaagaattttgggattacagcttttattgttattaaggtatagcttatgcattaaataatttcttctttcaaaacaccacaccaagcgacacccacacacaagacacattgtgcggccgcaccgggccctcagaaaaatttcgaaaaccacttcgtggggccgacgccgccccaggggtcacggtcaatcgggcacaggcggtcccaagaagaccgcgcagcacaaggccgggatccccccaaaaaaccgcccgggagccgcgtcgcaccacacagagggtcgaggacacggtctcacaggccaaggcgataac

SEQ ID NO: 291687 - DNA, 1880 bp, Homo sapiens
  misc_feature (1565)..(1565): n is a, c, g, or t
acaaaattactttatcaaaaacaaattagctagaaaaaaaattacatcttatgttttcttatatagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtgagagtctagttgtcttcatgtacataatttttgtttgtgttgctttgcacatgtaaacatttattgaataaatatgcttcatttctttttccacctgtaactctaaaactacaacttaaaaaattataaaaattgtttgagttgacttcacagtcagtttgatcagtatggtcccccacctggattgtttatttttaaataaaaaacagacttcttttttacagaatattaatattctagttagtatgaagcaattaaaaattattaaagttaatagggatgggatggaagaaatgttcaatgtagcaaaatgttagcaaatgttatttttgaatattgggattacagatgtttcttatgttttttcattatactttaaggtagtttccaaatattaaaggaaaaataaaggatactatttaagtctagttttttagtgaagtcattctgaaaagcaggactttgtttttaatgtgcaactattatggggttattttcattttatgaggattaaatgaagtaaatgtgaaagggttttataaaatgtaacattttgtacaggtgcttattgatgttgttactctctagtgcgttgaataaatgtaattacattgataataatattctaaaacctattggaaattaagaacaaagtgaaaacttttctctaggtgctgtccgatttctacatcaattaaatccgtttccttttgttggatagggaatggtctcaaatcctagatgtgaccgtgtagcttatgttaatgtcacactaatgtgaaaagataagaaccagaataggaaatttgtcatgcaaaccattggagtttcaaaatgaaggtggtgagcagtatcagatgcttagaggaatataaggaaaatggagactgagaaaattctgtttaatttggtgattgggaggcagttggtacctttcaagataccaattaaatgagagcataagtaaaaggtttgctcagtatatctatctttaacacaaagatgaatgtctttattttatataaaattactgtccttttttttcttgacatgtttttatttccttttctccccttaccataatggatgctctgtgaaaacaagggctttgttttatcttgttttatttactgctacatctgccatcaccgagancagtatgtgtagcaggcttacaagaaatacttgtggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagatcccgccactgcactccagcctgggcgacagagcgagactccgtctc

SEQ ID NO: 291688 - DNA, 391 bp, Homo sapiens
  misc_feature (7)..(7): n is a, c, g, or t
  misc_feature (16)..(16): n is a, c, g, or t
acaaatnaatataatnggggaaaatttttttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291689 - DNA, 335 bp, Homo sapiens
caattctcctgcctcagcctcccaagtagctgggactacaggtgtgtgccaccacacccggctaattgttgtatttttagtagagacagggtttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291690 - DNA, 1532 bp, Homo sapiens
tgcgcgcgccggaagtacctacctgggataacggcggcgagcggacggctgcatttacggggtctcccggagggccagagtcggaaattgttgaaaacgttaaatttgattcctaaaaggactcaatggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291691 - DNA, 1489 bp, Homo sapiens
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291692 - DNA, 1601 bp, Homo sapiens
  misc_feature (22)..(22): n is a, c, g, or t
gggctgctctagaggtccccgnacatgtcgtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291693 - DNA, 1435 bp, Homo sapiens
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291694 - DNA, 1432 bp, Homo sapiens
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291695 - DNA, 1640 bp, Homo sapiens
tgcgcgcgccggaagtacctacctgggataacggcggcgagcggacggctgcatttacggggtctcccggagggccagagtcggaaattgttgaaaacgttaaatttgattcctaaaaggactcaatggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291696 - DNA, 3417 bp, Homo sapiens
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcagccctctttggattccagcacgacgcatcaaaccataccatagtggggctaggacccaacccagtaccagaaatgaaggaaacgaccctgcaggccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaactgctatgcctgacaaaactgttgctgcacacatctgtactcgtcaatcaacaaaacctgatgcaaaaaacagaaaaggggtgatgtaggagatggtcaggttggtaggagaagctataaggaaagacgcaattggaaggtcgggaggttttccaaagcttcaggagagaataaagctgaaggcagctttattaattaattctcttaccctgaggctgagggcgaacagtaggtagcaagggagtgtaaaggaatttatctagataagtttgtttacttatgccctccggaaatcatgcaagactgctccctgcaaaggggggcgacaatgttcattactcacaaattgtgttggcttcaggcctttggtattctgtctctactgaataaatacaaatggttccagcctatcaggactgcactctcttctcggctgcactaaagctggcactcccccagccgttctcatgcaaaatacctgtgtcagaatactcctttcatccatcactcagccagagtcttcaggacagactcggcatgggacttgtccaaaaaaattctaatcaaaagaggaaaattttggaatatgccaggaatagtggaattttattttttaaatttttttataggcccatatgctctatctcaagaaacaagatgattgtaacatgtccatgattaaactattggcagattattgctgtgttaatctctgtagtctaatgagttctttgttctgttctgctgccttttacgttttcttgtcctttcaaaagtgttcttgaaagaaacaaagcgaataggcagttagcacagcacagctaccccttaccaagcagtctatggaaacaacccctcatccaaatcatgggttagttaagaatctaactggggcaattaagatgaattccactcacttcctggtcacttcagcagcccagcggcattgagccaaaatatacaattctgtgttattagtgaggaaactttaaaactcatgtttgttattacttactacccaatttcattatcctcccttcctctttccatttctattctctctcacttgaattctggcattatttttagtggcctctactgataatacctaccctagagtacataaaaattatattaaaagaggaagtagcagtatgcataattttaacagattctataatgggtgcctcaaaatatgtattgtgccattccgcaaatttaaaagctaattgaggacaatttttttttaatttcctaaatgagaccaccttggatttttatttttgccatttagatgtttatacttatttagcttttataaaacataagccaagtaatcccacataacaactctggtattcttccctcatatgagcagtgattttatttgttacccaccttagatagactaagaaagttctagtcttgtttctccttctccccgcttccctgggggtttttccttaccataagtattctggtccgagggttcagttcctttagtcaagatgtcacaagtttaaaaacaaaacttgagaaactaccaaaggctcaggagttgtccactttgttgaaatccattaaattagagaagtctcactaacagatgtatttaaatataggtacaacaaataatttctttttctccccttccccaaattacagtcagcatttaaagctgtttatggcttgccatcagcattattctggtaggcttgttagtgttaaaatctatttgattttttttttttttttttgcctcttaaagtctaattttaggatggatgaattcagatgtttaccagagtgtgtattttacataatgttcttgattaaaaagacttgtttgtaaattatccgttgtttttgcatatgcccagttgatgtgataaaattttcattgtcttgccatataaagccttggttatcaacaggtggaatgtagatattgtaaagctttttgtgaattaaaagtgcaaaataaagcaaccacatttaaaaaaaaaaaa

SEQ ID NO: 291697 - DNA, 1220 bp, Homo sapiens
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291698 - DNA, 2780 bp, Homo sapiens
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcagccctctttggattccagcacgacgcatcaaaccataccatagtggggctaggacccaacccagtaccagaaatgaaggaaacgaccctgcaggccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaactgctatgcctgacaaaactgttgctgcacacatctgtactcgtcaatcaacaaaacctgatgcaaaaaacagaaaaggggtgatgtaggagatggtcaggttggtaggagaagctataaggaaagacgcaattggaaggtcgggaggttttccaaagcttcaggagagaataaagctgaaggcagctttattaattaattctcttaccctgaggctgagggcgaacagtaggtagcaagggagtgtaaaggaatttatctagataagtttgtttacttatgccctccggaaatcatgcaagactgctccctgcaaaggggggcgacaatgttcattactcacaaattgtgttggcttcaggcctttggtattctgtctctactgaataaatacaaatggttccagcctatcaggactgcactctcttctcggctgcactaaagctggcactcccccagccgttctcatgcaaaatacctgtgtcagaatactcctttcatccatcactcagccagagtcttcaggacagactcggcatgggacttgtccaaaaaaattctaatcaaaagaggaaaattttggaatatgccaggaatagtggaattttattttttaaatttttttataggcccatatgctctatctcaagaaacaagatgattgtaacatgtccatgattaaactattggcagattattgctgtgttaatctctgtagtctaatgagttctttgttctgttctgctgccttttacgttttcttgtcctttcaaaagtgttcttgaaagaaacaaagcgaataggcagttagcacagcacagctaccccttaccaagcagtctatggaaacaacccctcatccaaatcatgggttagttaagaatctaactggggcaattaagatgaattccactcacttcctggtcacttcagcagcccagcggcattgagccaaaatatacaattctgtgttattagtgaggaaactttaaaactcatgtttgttattacttactacccaatttcattatcctcccttcctctttccatttctattctctctcacttgaattctggcattatttttagtggcctctactgataatacctaccctagagtacataaaaattatattaaaagaggaagtagcagtatgcataattttaacagattctataatgggtgcctcaaaatatgtattgtgccattccgcaaatttaaaagctaattgaggacaatttttttttaatttcctaaatgagaccaccttggatttttatttttgccatttagatgtttatacttatttagcttttataaaacataacgcgagtcaatgtgcagtcgtttatcctctagaagcagctatga

SEQ ID NO: 291699 - DNA, 1056 bp, Homo sapiens
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttgggcgacatgttcgggggatcctctaggg

SEQ ID NO: 291700 - DNA, 988 bp, Homo sapiens
  misc_feature (39)..(39): n is a, c, g, or t
  misc_feature (48)..(48): n is a, c, g, or t
  misc_feature (72)..(72): n is a, c, g, or t
gagaggaacctgaagggtaagggagcctgtccgtcgaancctcagggntcttccccctcagtggttcagcantttcttcatcaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291701 - DNA, 1435 bp, Homo sapiens
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291702 - DNA, 973 bp, Homo sapiens
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggacattagagatggcgtttagaagaaaaagtttctactcttcccattatgcgagagagcgtctccttataaaagggacaatactttttcagagatcacctgtgccgaaagattccatagcgggccg

SEQ ID NO: 291703 - DNA, 1005 bp, Homo sapiens
tccaacaaataaatgaacaaagtcattgatatgtcttccctagcctttgttcttattctcatctctagtctgatgtcctttgagtagactgccttacactgacaaatgccatgccaaacttctatattcagtaatgtagtttgttaatgttttccttctcattcaggtattgtcagcagatctcatggatagaggtttaaatggcctctggtaatagtgacaatgcaagggcgagaaaggttccgctttcttttttgtgtctctcttttagatgtcagcatcataattctgccaactcagttagctaagtatttggctagttattttcattctcagctaaccagaatgtgttttaccttttaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291704 - DNA, 817 bp, Homo sapiens
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291705 - DNA, 1813 bp, Homo sapiens
acccctttggataggcacttgagaacccctcacggggtagcaagggagtgtaaaggaatttatctagataagtttgtttacttatgccctccggaaatcatgcaagactgctccctgcaaaggggggcgacaatgttcattactcacaaattgtgttggcttcaggcctttggtattctgtctctactgaataaatacaaatggttccagcctatcaggactgcactctcttctcggctgcactaaagctggcactcccccagccgttctcatgcaaaatacctgtgtcagaatactcctttcatccatcactcagccagagtcttcaggacagactcggcatgggacttgtccaaaaaaattctaatcaaaagaggaaaattttggaatatgccaggaatagtggaattttattttttaaatttttttataggcccatatgctctatctcaagaaacaagatgattgtaacatgtccatgattaaactattggcagattattgctgtgttaatctctgtagtctaatgagttctttgttctgttctgctgccttttacgttttcttgtcctttcaaaagtgttcttgaaagaaacaaagcgaataggcagttagcacagcacagctaccccttaccaagcagtctatggaaacaacccctcatccaaatcatgggttagttaagaatctaactggggcaattaagatgaattccactcacttcctggtcacttcagcagcccagcggcattgagccaaaatatacaattctgtgttattagtgaggaaactttaaaactcatgtttgttattacttactacccaatttcattatcctcccttcctctttccatttctattctctctcacttgaattctggcattatttttagtggcctctactgataatacctaccctagagtacataaaaattatattaaaagaggaagtagcagtatgcataattttaacagattctataatgggtgcctcaaaatatgtattgtgccattccgcaaatttaaaagctaattgaggacaatttttttttaatttcctaaatgagaccaccttggatttttatttttgccatttagatgtttatacttatttagcttttataaaacataagccaagtaatcccacataacaactctggtattcttccctcatatgagcagtgattttatttgttacccaccttagatagactaagaaagttctagtcttgtttctccttctccccgcttccctgggggtttttccttaccataagtattctggtccgagggttcagttcctttagtcaagatgtcacaagtttaaaaacaaaacttgagaaactaccaaaggctcaggagttgtccactttgttgaaatccattaaattagagaagtctcactaacagatgtatttaaatataggtacaacaaataatttctttttctccccttccccaaattacagtcagcatttaaagctgtttatggcttgccatcagcattattctggtaggcttgttagtgttaaaatctatttgattttttttttttttttttgcctcttaaagtctaattttaggatggatgaattcagatgtttaccagagtgtgtattttacataatgttcttgattaaaaagacttgtttgtaaattatccgttgtttttgcatatgcccagttgatgtgataaaattttcattgtcttgccatataaagccttggttatcaacaggtggaatgtagatattgtaaagctttttgtgaattaaaagtgcaaaataaagcaaccacatttaaaaaaaaaaaa

SEQ ID NO: 291706 - DNA, 507 bp, Homo sapiens
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagtagagatggggtttcgccgtgttagccaggatggtctccatctcctgacctcgtgatctgcccgtctcggcctcccaaagtgctgggattacaggcgtgagtcac

SEQ ID NO: 291707 - DNA, 337 bp, Homo sapiens
  misc_feature (22)..(22): n is a, c, g, or t
gggctgctctagaggtccccgnacatgtcgtggcttacagaagagacgaaatgtggtctgagggacgatatgaatatgaaagaattccgagagaacgagcacctcctcgaagtcatcccagtgatggctacaatagactagttaatattgtgccaaagaaaccccgtctctactaaaaatacaacaaattagccaggcgtggtggcgcatgcctgtaatcccagctactcgggaggctgaggtgagagaatggcatgaacccaggaggcggagcttgcagtgagctgagatggtgccactgcactccagcctgggcgacagagcgagactccatctc

SEQ ID NO: 291708 - DNA, 376 bp, Homo sapiens
tgattggttttcgcattgctgcatgtcattttgaacacctggctttcttcgttgaacaacttgatttcctttaatccatgtgaagaccttagtattagttatatttatgttatttcattaacgcttttgtttatacatttagctcattcgattaagggtaagaactcctgtgctttttaaaaacctttccaaaaccaaatagagaaattagtcatttgtatatatttctttttgtctgttttaggatggctacaatagactagttaatattgtgccaaagaaaccaccactgctagacagacctggtgaaggaagctacaatagatattacagtcatgttgattaccgagactatgacgagggccgcagtttttct

SEQ ID NO: 291709 - DNA, 440 bp, Homo sapiens
tttttaaagaaaatctcaaaattgtttggaagaaacattctttcttttggtcactttcattttttttttttctcttaagatctctggaaaatatttgtgttggaaagtaatcatttactccttccttaccttttctgttacttcctagtataaaatccataattcttttttttttctttagtggcttacagaagagacgaaatgtggtctgagggacgatatgaatatgaaagaattccgagagaacgagcacctcctcgaagtcatcccagtgtaagttactcctacatattgaatgattcaaaaacctggtgtctgaattaatttgatacaccaaagctaggcctattaacaaaatcttcaagtgtcagaaatttaccagtgtagtttacaaaagagatcaagcttatcttttaaaagttaaaagttcaaaaataaaa

SEQ ID NO: 291710 - DNA, 1567 bp, Homo sapiens
tgcgcgcgccggaagtacctacctgggataacggcggcgagcggacggctgcatttacggggtctcccggagggccagagtcggaaattgttgaaaacgttaaatttgattcctaaaaggactcaatggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatcttaaaaaaagggcctcttggcgccaataaatcttagct

SEQ ID NO: 291711 - DNA, 1654 bp, Homo sapiens
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291712 - DNA, 1580 bp, Homo sapiens
ccttagctctctgggtcgataccagtttttatgtttttgacacactgtcaccaaaagacgttggaatgactcagaaacaccaatatttcattcaagaatcagatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291713 - DNA, 1597 bp, Homo sapiens
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291714 - DNA, 1546 bp, Homo sapiens
tgcgcgcgccggaagtacctacctgggataacggcggcgagcggacggctgcatttacggggtctcccggagggccagagtcggtgggacgagagactgagaaaagaaataagacacagagacaaagtatagagaaagaacagtgggcccaggagaccaacacttagcatatggaggacctgcaccggcaccagtcttggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291715 - DNA, 1286 bp, Homo sapiens
  misc_feature (22)..(22): n is a, c, g, or t
gggctgctctagaggtccccgnacatgtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagagaatcacctgttggccgaaaggattctccacacagcagatctggttccagtgtcagtagcagaagctactctccagaaaggagcaaatcatactctttccatcagtctcaacatagaaataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291716 - DNA, 2261 bp, Homo sapiens
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcagccctctttggattccagcacgacgcatcaaaccataccatagtggggctaggacccaacccagtaccagaaatgaaggaaacgaccctgcaggccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaactgctatgcctgacaaaactgttgctgcacacatctgtactcgtcaatcaacaaaacctgatgcaaaaaacagaaaaggggtgatgtaggagatggtcaggttggtaggagaagctataaggaaagacgcaattggaaggtcgggaggttttccaaagcttcaggagagaataaagctgaaggcagctttattaattaattctcttaccctgaggctgagggcgaacagtaggtagcaagggagtgtaaaggaatttatctagataagtttgtttacttatgccctccggaaatcatgcaagactgctccctgcaaaggggggcgacaatgttcattactcacaaattgtgttggcttcaggcctttggtattctgtctctactgaataaatacaaatggttccagcctatcaggactgcactctcttctcggctgcactaaagctggcactcccccagccgttctcatgcaaaatacctgtgtcagaatactcctttcatccatcactcagccagagtcttcaggacagactcggcatgggacttgtccaaaaaaattctaatcaaaagaggaaaattttggaatatgccaggaatagtggaattttattttttaaatttttttataggcccatatgctctatctcaagaaacaagatgattgtaacatgtccatgattaaactattgtttgtaaattatccgttgtttttgcatatgcccagttgatgtgataaaattttcattgtcttgccatataaagccttggttatcaacaggtggaatgtagatattgtaaagctttttgtgaattaaaagtgcaaaataaagcaaccacatttaaaaaaaaaaaa

SEQ ID NO: 291717 - DNA, 1478 bp, Homo sapiens
cccactcatgtgcaacctttaccactttctgatggcaggagggtagcttatcagcaccccggttgcttagtctgcctccagttctactgtgggtcctcgtcctccaagaaccacagtttgacttcctggaagggtggctgatggcctatctctggtcacctgggtggtattctgctggtcagagatgagacagaagccctctagtctgcctcagccactggaggttgggtcagggagctggtgcttcaagaattgaggctcagggacacgaccacctcaggggccctgcagtgctggtctggggaagcaagcttttacacacggcccgccttgctcggaggtgccacggtgtttgaaatgaagcctgggggtgacagactcagtacaggcaggggaagctcctttctgggcaccctggaccccagtggggccggaaggagatgcagacaggcctcctcacaaccacccgcaacgcgttcggatgcccctcagctccaggcaccatgccccctacagcctgcagggcaggttctgtgccagagttgtttccagggaccgcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctta

SEQ ID NO: 291718 - DNA, 1089 bp, Homo sapiens
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcagatatgcttgtgttcacatcccctca

SEQ ID NO: 291719 - DNA, 2320 bp, Homo sapiens
  misc_feature (2005)..(2005): n is a, c, g, or t
tgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtgagagtctagttgtcttcatgtacataatttttgtttgtgttgctttgcacatgtaaacatttattgaataaatatgcttcatttctttttccacctgtaactctaaaactacaacttaaaaaattataaaaattgtttgagttgacttcacagtcagtttgatcagtatggtcccccacctggattgtttatttttaaataaaaaacagacttcttttttacagaatattaatattctagttagtatgaagcaattaaaaattattaaagttaatagggatgggatggaagaaatgttcaatgtagcaaaatgttagcaaatgttatttttgaatattgggattacagatgtttcttatgttttttcattatactttaaggtagtttccaaatattaaaggaaaaataaaggatactatttaagtctagttttttagtgaagtcattctgaaaagcaggactttgtttttaatgtgcaactattatggggttattttcattttatgaggattaaatgaagtaaatgtgaaagggttttataaaatgtaacattttgtacaggtgcttattgatgttgttactctctagtgcgttgaataaatgtaattacattgataataatattctaaaacctattggaaattaagaacaaagtgaaaacttttctctaggtgctgtccgatttctacatcaattaaatccgtttccttttgttggatagggaatggtctcaaatcctagatgtgaccgtgtagcttatgttaatgtcacactaatgtgaaaagataagaaccagaataggaaatttgtcatgcaaaccattggagtttcaaaatgaaggtggtgagcagtatcagatgcttagaggaatataaggaaaatggagactgagaaaattctgtttaatttggtgattgggaggcagttggtacctttcaagataccaattaaatgagagcataagtaaaaggtttgctcagtatatctatctttaacacaaagatgaatgtctttattttatataaaattactgtccttttttttcttgacatgtttttatttccttttctccccttaccataatggatgctctgtgaaaacaagggctttgttttatcttgttttatttactgctacatctgccatcaccgagancagtatgtgtagcaggcttacaagaaatacttgtggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagatcccgccactgcactccagcctgggcgacagagcgagactccgtctc

SEQ ID NO: 291720 - DNA, 822 bp, Homo sapiens
tgcgcgcgccggaagtacctacctgggataacggcggcgagcggacggctgcatttacggggtctcccggagggccagagtcggaaattgttgaaaacgttaaatttgattcctaaaaggactcaatggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaagtatgtattttaagactttatttttttctctcacagtctcctctgatgagaatgtactgagtcagatttccttctaggtgtaagagatttattttttaaactttttattttgaaaaatttcaaacttacagaaaagatggtagaatagtataacaaacaccatacacacacatttttttcaaactatttgaagtggcattctgcatgacacttacctttaatttcttcagcatgtaaaaggttttttttttttttttttcagagtctcgctctgtctcccaggctggagtgtagtggcacgatcttgtttcactgcagtctccgcctccc

SEQ ID NO: 291721 - DNA, 718 bp, Homo sapiens
ggattctataggatagtatttaacaacctgaaacataaatttatcaggcacaggttagattttctttccattgtgattatttgtccctgcatcccacatgattatttgccagtcagatttgtgtgtctcaaaataactggacaagaggagtaaacttcctttataaaaatgaaccattattgcagcaagaggactgatttcaaaagatgacctggaaaactgtttagtcttgttaaaatatttggcctcatcttcaaaatgtatacatgaatctttcattttgggattgaaatatctttctgatttagaaaagaagcttgattaagaaggagatgtcaacttttacctcccccgcccccaacaaaaaaacagtttcagaaatttatgattaatttaaaagcagttaagataataaagcaaacaattttgtaaaattttttgagggtaatgagtaaactggaatgctcaatgtatactaaaaatactcctgatcttagtaaccagtttttattacatccttagtgtttgtactaacactaaattggtgattataaatttatttacttgatagtatagtatatgtaatattcaacagagtgttaatgcaaaaactgaaaaaattaaaacattttgcttttttgcttaatcggtaaattttcctttctactacctttaaagatggtgcttttggctgggcgtggtggctcatgcctatata

SEQ ID NO: 291722 - DNA, 746 bp, Homo sapiens
ggattctataggatagtatttaacaacctgaaacataaatttatcaggcacaggttagattttctttccattgtgattatttgtccctgcatcccacatgattatttgccagtcagatttgtgtgtctcaaaataactggacaagaggagtaaacttcctttataaaaatgaaccattattgcagcaagaggactgatttcaaaagatgacctggaaaactgtttagtcttgttaaaatatttggcctcatcttcaaaatgtatacatgaatctttcattttgggattgaaatatctttctgatttagaaaagaagcttgattaagaaggagatgtcaacttttacctcccccgcccccaacaaaaaaacagtttcagaaatttatgattaatttaaaagcagttaagataataaagcaaacaattttgtaaaattttttgagggtaatgagtaaactggaatgctcaatgtatactaaaaatactcctgatcttagtaaccagtttttattacatccttagtgtttgtactaacactaaattggtgattataaatttatttacttgatagtatagtagtatatgaacactagtgtttatgtatacatgtgcaggtttgttatataggtcaattgcatgtaatgggggcttggggtacagagtagggcataacacaggtcatgagcatagtacgtagcagggagttaaacgagtcggcccgtgaaagctggctcccggtagaacat

SEQ ID NO: 291723 - DNA, 710 bp, Homo sapiens
agcgggggcggtaactcgcaggccggacgtgacgcaaggcgggggctgagctgcgccggccggaaacccagcaggcggcgaagatggcggagaacagcggtcgcgccggcaagagcagcgggagcggcgcggggaagggggcggtgtccgcagagcaggtgattgctggcttcaaccgccttcggcaggaacagcgaggcctggcatccaaagcagctgagttggagatggagttgaatgagcacagcctagtgatcgatacactgaaggaggtagatgaaactcgtaagtgctaccgcatggttggaggagtgctggtggagcgaactgtcaaagaggtgctgcccgctttggagaacaacaaggagcagatacagaagatcattgagacactgacacagcagcttcaggcaaagggaaaagaactaaatgaattccgggaaaagcacaacattcgtctcatgggagaagatgagaagccagcagccaaggaaaactcagaaggggctggggctaaggccagctcagctggagtgttggtctcctagggaccaaggcctttgcatttttttctaccctgactcccacttctaatttctctttattgttattattattattttctctgctattgtaatatttttttgttaattaaatgttttggtcagaatcttaaaaaaaaaaaaatcactggccgtcgtttacaacgc

SEQ ID NO: 291724 - DNA, 406 bp, Homo sapiens
  misc_feature (5)..(5): n is a, c, g, or t
  misc_feature (112)..(112): n is a, c, g, or t
  misc_feature (151)..(151): n is a, c, g, or t
  misc_feature (172)..(172): n is a, c, g, or t
  misc_feature (184)..(184): n is a, c, g, or t
  misc_feature (200)..(200): n is a, c, g, or t
agttnttcatactgtttaacaagaccacagcaggtaaggattaatttttgagtggctgctggaattacttgatttgaatacttaggggcccccccccaaaaaaaaccccccnaaaaaaaaaaacccccaaaatttttttttcccccggggnttttccccctttcccccaaanttgggggggggngaaggaaaaaaagganattgtagaagccagcagccaaggaaaactcagaaggggctggggctaaggccagctcagctggagtgttggtctcctagggaccaaggcctttgcatttttttctaccctgactcccacttctaatttctctttattgttattattattattttctctgctattgtaatatttttttgttaattaaatgttttggtcagaatctta

SEQ ID NO: 291725 - DNA, 914 bp, Homo sapiens
gtaggaacttgtctctgtaaaaaataaaaataagcagcccaggtgattctaagtacattaaagtgtataaaccactgtgttcaagaaaggaataattttaatgtctgggctcctctacttggttaaaggtaaggttaaatgtgttaacacttcctccaaccatagtccattccaggtgggggaaaggagtcctgaattccttatataatccctgtcacttgtcctctagatacagaagatcattgagacactgacacagcagcttcaggcaaagggaaaagaactaaatgaattccgggaaaagcacaacattcgtctcatgggagaagatgagaagccagcagccaaggaaaactcagaaggggctggggctaaggccagctcagctggagtgttggtctcctagggaccaaggcctttgcatttttttctaccctgactcccacttctaatttctctttattgttattattattattttctctgctattgtaatatttttttgttaattaaatgttttggtcagaatcttaaaaaaacgaacaacacaacacgaaaaatgaacaacgtcagacgaacaaagcaagaagaagagagacagacacaacgaccgaggcaagacgaagagagcaggacagagaacaagccacgacatgaataacagcagacccaacgaaaccaaaaacatgggcggcgggacgccccccgcgccacgaacaaagagaaaccacaaacaccagatcggtgggggcgccgccaccccaagataagatagagaaaggagccgcgacgcagacacgaaagaaaggctgacacaggggtgaggggcccaccaaaaaaaaagcgcgggggggggcgaagactagaaaaaaagggggcgtagatcaacggtacacaaggacgcgagggaaaaa

SEQ ID NO: 291726 - DNA, 977 bp, Homo sapiens
agcgggggcggtaactcgcaggccggacgtgacgcaaggcgggggctgagctgcgccggccggaaacccagcaggcggcgaagatggcggagaacagcggtcgcgccggcaagagcagcgggagcggcgcggggaagggggcggtgtccgcagagcaggtgattgctggcttcaaccgccttcggcaggaacagcgaggcctggcatccaaagcagctgagttggagatggagttgaatgagcacagcctagtgatcgatacactgaaggaggtagatgaaactcgtaagtgctaccgcatggttggaggagtgctggtggagcgaactgtcaaagaggtgctgcccgctttggagaacaacaaggagcagatacagaagatcattgagacactgacacagcagcttcaggcaaagggaaaagaactaaatgaattccgggaaaagcacaacattcgtctcatgggagaagatgagaagccagcagccaaggaaaactcagaaggggctggggctaaggccagctcagctggagtgttggtctcctagggaccaaggcctttgcatttttttctaccctgactcccacttctaatttctctttattgttattattattattttctctgctattgtaatatttttttgttaattaaatgttttggtcagaatcttaaaaaaaaacggcacgagtttttttttctacattttattatttcaaaccaggtgaacaattccataaaacatgtgaaaaaagcaaggaagtgttcaacgctgaaggccccgggcctgggacaagggcatgaggggcgtggccccccagcagacagcggcggttcctaggttagcgctagggagctacattttaggttaatagagcctggggccagggccgctggggcagggccctcagtgacgttggcagttgtctggaacagcccttggaacccaattctgtggagggcagggcaggggtgc

SEQ ID NO: 291727 - DNA, 675 bp, Homo sapiens
agcgggggcggtaactcgcaggccggacgtgacgcaaggcgggggctgagctgcgccggccggaaacccagcaggcggcgaagatggcggagaacagcggtcgcgccggcaagagcagcgggagcggcgcggggaagggggcggtgtccgcagagcaggtgattgctggcttcaaccgccttcggcaggaacagcgaggcctggcatccaaagcagctgagttggagatggagttgaatgagcacagcctagtgatcgatacactgaaggaggtagatgaaactcgtaagtgctaccgcatggttggaggagtgctggtggagcgaactgtcaaagaggtgctgcccgctttggagaacaacaaggagcagatacagaagatcattgagacactgacacagcagcttcaggcaaagggaaaagaactaaatgaattccgggaaaagcacaacattcgtctcatgggagaagatgagaagccagcagccaaggaaaactcagaaggggctggggctaaggccagctcagctggagtgttggtctcctagggaccaaggcctttgcatttttttctaccctgactcccacttctaatttctctttattgttattattattattttctctgctattgtaatatttttttgttaattaaatgttttggtcagaatctta

SEQ ID NO: 291728 - DNA, 771 bp, Homo sapiens
  misc_feature (474)..(474): n is a, c, g, or t
  misc_feature (485)..(487): n is a, c, g, or t
  misc_feature (504)..(505): n is a, c, g, or t
  misc_feature (521)..(521): n is a, c, g, or t
  misc_feature (533)..(533): n is a, c, g, or t
  misc_feature (543)..(543): n is a, c, g, or t
agcgggggcggtaactcgcaggccggacgtgacgcaaggcgggggctgagctgcgccggccggaaacccagcaggcggcgaagatggcggagaacagcggtcgcgccggcaagagcagcgggagcggcgcggggaagggggcggtgtccgcagagcaggtgattgctggcttcaaccgccttcggcaggaacagcgaggcctggcatccaaagcagctgagttggagatggagttgaatgagcacagcctagtgatcgatacactgaaggaggtagatgaaactcgtaagtgctaccgcatggttggaggagtgctggtggagcgaactgtcaaagaggtgctgcccgctttggagaacaacaaggagcagatacagaagatcattgagacactgacacagcagcttcaggcaaagggaaaagaactaaatgaattccgggaaaagcccccttttttttggggggttttttttnccccctttttnnncccccgcccctttgggnnccccccccccccgggnaaaatttttggntccggagggncccaaaacccaagccccggaagcgccgtgttgacttcccgggcggcctgctgagcctggggcccggcgaagggcccgggcgccatccccgacgcggccaacggaggggtggacatggcgcggctgcagcttcaggccggaaggggccagacagcaggtgtcaggggtctgcccggaattgggaggctgtggggcctcagcgttggaaccagcttgagagaccccccgc

SEQ ID NO: 291729 - DNA, 1207 bp, Homo sapiens
cgactgcaagcgctgccacctgaggagcctggtagccaaggcagcggcaggctcaacccagatctcgcgagacggagcacgcctagcggagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacaggcttcaaagctgcacagagtctacgttttagagagttggcacctttgatgtggtagtgagctgatcatccactttcttctaaaataaagagaagaaaatggccagtattcatcctgtccttctctttccccattccttgataactctcttgtctttactgggaagctggagagtcacagtctagtagaagaaagattagaaaaatttcaactgtaggtgcctttgcaacctatcctgggagaccctaaaacatatttagttttagtgcctagagattttcactcctctaacatctctggatacagtgtccctggtcaacatgaagaagttacagaagaacgctttctgatcctggcccctaaagaatttacttgtgctaagtaataaaattcctattgatcaaaacctgaaaacttgtg

SEQ ID NO: 291730 - DNA, 895 bp, Homo sapiens
cgactgcaagcgctgccacctgaggagcctggtagccaaggcagcggcaggctcaacccagatctcgcgagacggagcacgcctagcggagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacaggcttcaaagctgcacagagtctacgttttagagagttggcacctttgatgtggtagtgagctgatcatccactttcttctaaaataaagagaagaaaatggccagta

SEQ ID NO: 291731 - DNA, 775 bp, Homo sapiens
cgactgcaagcgctgccacctgaggagcctggtagccaaggcagcggcaggctcaacccagatctcgcgagacggagcacgcctagcggagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccaggtaggggccggcgccgcccgcagggtggcgcagacgcgagaggtgggggtgcaagacaaatcccgggacaagccctcgctctgcgggtcgtaggtggaagaggtttccgatattatctacctaagaggagagaggttcaaaacagtcacttaacacccaaagtcaccaaagaaattggtgacaaaactgcaagtagcatccagttcttagtgattgtgcttataccatgctgcagagtgaaacccctgatctatgaactgcacctcgcc

SEQ ID NO: 291732 - DNA, 517 bp, Homo sapiens
tgcctaatttttgtatttttagtagagacggggtttcaccatgttgcccaggctgatcttgaattcagggtgatctgcgcgccttggcctcgcaaagtgctgggattacaggggtgagccaccacatcaggcctaatagccatacttctaattctgtttgagaagttctcaaattagcaataccaagtgttacttggtttcttcccctaatgaggccactaattttattgctcttactactgttgtttggtccctgcatctttaacctcttcgtaaaatttgtatcttccagattagaaaaatttcaactgtaggtgcctttgcaacctatcctgggagaccctaaaacatatttagttttagtgcctagagattttcactcctctaacatctctggatacagtgtccctggtcaacatgaagaagttacagaagaacgctttctgatcctggcccctaaagaatttacttgtgctaagtaataaaattcctattgatcaaaacctgaaaacttgtg

SEQ ID NO: 291733 - DNA, 605 bp, Homo sapiens
cgactgcaagcgctgccacctgaggagcctggtagccaaggcagcggcaggctcaacccagatctcgcgagacggagcacgcctagcggagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccaggctggagtagctcttattgcccaggctggagtagctcttattgcccaggctggagtagctctatgcccaggctggagtagctcttatgcccaggatgga

SEQ ID NO: 291734 - DNA, 752 bp, Homo sapiens
gacttaattgatttatttcagatcaaccatagtggagttatttagatgtaaaaaaaaaattatttgtcaaaagaaattaagaatagcactccccacaccagatctttatatgtcactaacaaaaagtatacaaagaaaaataacattccacattcaacagtctctataaacaagttgatcccctgccagaacctattcaatttgaatttggccatgagtagtattctcatgttgatttataacctaagactctttactattcaaggcaaaacacagccctgagctctggcattaaaacagcaaccaacaaattagcattatccttgaaaaattcaaccaaacatctgcacccaaacaccctgagacaaagcacttcagattggaataaaatataaaactggattcacatatttaaatgaaatgtttcagtgtgtttttactgaaggattgtttgccacagatggatgagaatatgagagaaaaagtcataaatcatttcattttagagctctgaaaggcccaggaagaccaggtggaactagaaatattgctgtggctatttaaaaaatattatctgccacatatccgtttactttgatatttaatttttcaattttagtttaacacacgtgttaacatcataagttaaaaagtttatatctggaaaagccgccattgtggactactacctttgaaatctatttaatgatgaattttcctttttacatcccacataaagaggatatatttaa

SEQ ID NO: 291735 - DNA, 2498 bp, Homo sapiens
cgactgcaagcgctgccacctgaggagcctggtagccaaggcagcggcaggctcaacccagatctcgcgagacggagcacgcctagcggagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacagtgcttctgttttgaagaacaaaggcttaatccccaagaggaagtagatatgccagtgtttttctacattgatcctgaatttgctgaagatccaagaatgattaaagttgatcttatcactctttcttacactttttttgaagcaaaggaagggcacaagttgccagttccaggatataattgaagtcagcaactaagtcttccttcaaagttgtgatttttgggaaaatcatatatcctatcttctcaaaggagaaatattgtacaataatatgaaggcttatattttaaataattattttttctcaactaatttttttcacttaaacttgagagaacaagttcagcttttatcataagaaactcatatgcctagctagaatatatgactgactattcaataccatactgaagagtttgatactattaaaataagccgctttgttttttaaatatgcaggcatgggttcagcttaattccataattcccttccagattattaactcttcatacttacagcaatgaatctgacaatgtttttcaaaaatgtatgctcagggttatttgtttcaagtcataggccagaacttctaaccatgtttattgtgtctaaaagagttggttgctattttccttcattatgaatagtcagtattttaaaagctcaaagtagaagaggagtcactaagccctaacagcttgtccaaagatttaaattcttatttcaaatttgatttgtcctttaaggtttagggctattttatattcagagttctgaataattactttgaaactgtagtatcataaaattgaaataaaatacatctactaggctgttagccaaagcatcaccattacaagtccatgaatgttaaaatgtacaggtgggattgtgaagatttactgacatcaaaagttcttctggaaacaaacctttgttaaaaaaaaaaagtattaaattgttttaatagtgatttatttgtcatcaaatgtacaacttattctaaatattttcattttctgtgttctaaatagaaatattaagttgcagtaaaaagagaaaaaaaggctatttagcattacaaagaatcatatttaaaggctgcccaatgtagagtctagtgacctgttcaggacacctgaaatataattaaatgacaattatcaaggttttaacaatttataattctaaaccagaggattataaagaagtgcaaattgacttttacattcaactttagttaaatgaaggcactcagtattcttcctgaataatacattcagtttctcacattttatgctttcatctattcagaattatttcatagtaaaataatctactcttatcacagctgtgtgacgatttctaaatgtaggaaggcctgtgaaacatgacactgcagttaaattggttggcctaaggactaagtaatttttcttctgctgaagttttaagtgagtatttgttccaaacaagttctgttgaaatctcacgctgttgtcaggaatcagtgttatcctggaactgttattctatttaatcttcattatagcagaaatgtgccaccatggctttgacatgttggtaggtattgtcttccaggcttcaaagctgcacagagtctacgttttagagagttggcacctttgatgtggtagtgagctgatcatccactttcttctaaaataaagagaagaaaatggccagta

SEQ ID NO: 291736 - DNA, 2851 bp, Homo sapiens
cgactgcaagcgctgccacctgaggagcctggtagccaaggcagcggcaggctcaacccagatctcgcgagacggagcacgcctagcggagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacagtgcttctgttttgaagaacaaaggcttaatccccaagaggaagtagatatgccagtgtttttctacattgatcctgaatttgctgaagatccaagaatgattaaagttgatcttatcactctttcttacactttttttgaagcaaaggaagggcacaagttgccagttccaggatataattgaagtcagcaactaagtcttccttcaaagttgtgatttttgggaaaatcatatatcctatcttctcaaaggagaaatattgtacaataatatgaaggcttatattttaaataattattttttctcaactaatttttttcacttaaacttgagagaacaagttcagcttttatcataagaaactcatatgcctagctagaatatatgactgactattcaataccatactgaagagtttgatactattaaaataagccgctttgttttttaaatatgcaggcatgggttcagcttaattccataattcccttccagattattaactcttcatacttacagcaatgaatctgacaatgtttttcaaaaatgtatgctcagggttatttgtttcaagtcataggccagaacttctaaccatgtttattgtgtctaaaagagttggttgctattttccttcattatgaatagtcagtattttaaaagctcaaagtagaagaggagtcactaagccctaacagcttgtccaaagatttaaattcttatttcaaatttgatttgtcctttaaggtttagggctattttatattcagagttctgaataattactttgaaactgtagtatcataaaattgaaataaaatacatctactaggctgttagccaaagcatcaccattacaagtccatgaatgttaaaatgtacaggtgggattgtgaagatttactgacatcaaaagttcttctggaaacaaacctttgttaaaaaaaaaaagtattaaattgttttaatagtgatttatttgtcatcaaatgtacaacttattctaaatattttcattttctgtgttctaaatagaaatattaagttgcagtaaaaagagaaaaaaaggctatttagcattacaaagaatcatatttaaaggctgcccaatgtagagtctagtgacctgttcaggacacctgaaatataattaaatgacaattatcaaggttttaacaatttataattctaaaccagaggattataaagaagtgcaaattgacttttacattcaactttagttaaatgaaggcactcagtattcttcctgaataatacattcagtttctcacattttatgctttcatctattcagaattatttcatagtaaaataatctactcttatcacagctgtgtgacgatttctaaatgtaggaaggcctgtgaaacatgacactgcagttaaattggttggcctaaggactaagtaatttttcttctgctgaagttttaagtgagtatttgttccaaacaagttctgttgaaatctcacgctgttgtcaggaatcagtgttatcctggaactgttattctatttaatcttcattatagcagaaatgtgccaccatggctttgacatgttggtaggtattgtcttccaggcttcaaagctgcacagagtctacgttttagagagttggcacctttgatgtggtagtgagctgatcatccactttcttctaaaataaagagaagaaaatggccagtattcatcctgtccttctctttccccattccttgataactctcttgtctttactgggaagctggagagtcacagtctagtagaagaaagggtcactgtcacccaggctggagtgcagtggtgcaatcatggcttattgcagcttcgacctcccaggttcaagtgatccttccacttcagcctctcaaaatgttgggattagaggcataagccaccatgccaggcccattcaattctttatatgcgtcttacatatgtctgtagctggaaaatatacctgaaagcacaacattcatatatacagtatagcaaaacatggctgaggaaaaatctcaaaaatcacagcgctatgaaac

SEQ ID NO: 291737 - DNA, 2888 bp, Homo sapiens
cgactgcaagcgctgccacctgaggagcctggtagccaaggcagcggcaggctcaacccagatctcgcgagacggagcacgcctagcggagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacaggtacatcaaagtgtaaactttacagaatatgataaagatacatgaaacggtttagtatgaaacttagtgttttagtagatcttgtgatttctgaaaacgaatttcttctaaacatcaagctatttttcttcactatctatacctgctatgcagagattgagaaccaaaccaaatggatatctgcttttaagattagaatttgttcttcatccttaaagcagaactcattgagatgaaaagatgctcttaatttatcacagaactgtgtatttaatagtatgcttattaaaatcacgaagtgtactggaatgctaagataaaagaactgtatagtttctgttatgtaatacgagaatagaaatgttattaaaatctttctataatttccagtgcttctgttttgaagaacaaaggcttaatccccaagaggaagtagatatgccagtgtttttctacattgatcctgaatttgctgaagatccaagaatgattaaagttgatcttatcactctttcttacactttttttgaagcaaaggaagggcacaagttgccagttccaggatataattgaagtcagcaactaagtcttccttcaaagttgtgatttttgggaaaatcatatatcctatcttctcaaaggagaaatattgtacaataatatgaaggcttatattttaaataattattttttctcaactaatttttttcacttaaacttgagagaacaagttcagcttttatcataagaaactcatatgcctagctagaatatatgactgactattcaataccatactgaagagtttgatactattaaaataagccgctttgttttttaaatatgcaggcatgggttcagcttaattccataattcccttccagattattaactcttcatacttacagcaatgaatctgacaatgtttttcaaaaatgtatgctcagggttatttgtttcaagtcataggccagaacttctaaccatgtttattgtgtctaaaagagttggttgctattttccttcattatgaatagtcagtattttaaaagctcaaagtagaagaggagtcactaagccctaacagcttgtccaaagatttaaattcttatttcaaatttgatttgtcctttaaggtttagggctattttatattcagagttctgaataattactttgaaactgtagtatcataaaattgaaataaaatacatctactaggctgttagccaaagcatcaccattacaagtccatgaatgttaaaatgtacaggtgggattgtgaagatttactgacatcaaaagttcttctggaaacaaacctttgttaaaaaaaaaaagtattaaattgttttaatagtgatttatttgtcatcaaatgtacaacttattctaaatattttcattttctgtgttctaaatagaaatattaagttgcagtaaaaagagaaaaaaaggctatttagcattacaaagaatcatatttaaaggctgcccaatgtagagtctagtgacctgttcaggacacctgaaatataattaaatgacaattatcaaggttttaacaatttataattctaaaccagaggattataaagaagtgcaaattgacttttacattcaactttagttaaatgaaggcactcagtattcttcctgaataatacattcagtttctcacattttatgctttcatctattcagaattatttcatagtaaaataatctactcttatcacagctgtgtgacgatttctaaatgtaggaaggcctgtgaaacatgacactgcagttaaattggttggcctaaggactaagtaatttttcttctgctgaagttttaagtgagtatttgttccaaacaagttctgttgaaatctcacgctgttgtcaggaatcagtgttatcctggaactgttattctatttaatcttcattatagcagaaatgtgccaccatggctttgacatgttggtaggtattgtcttccaggcttcaaagctgcacagagtctacgttttagagagttggcacctttgatgtggtagtgagctgatcatccactttcttctaaaataaagagaagaaaatggccagta

SEQ ID NO: 291738 - DNA, 2643 bp, Homo sapiens
ttttattctgattttaaggtaagtttaatgttggtatctttttaaaaaaaatagtcaatcatgacattcaggtataagtgttacagaaaagttgggctagggctgtgatatgattggcttggacacattttaaataatgtaatttgccgattattccttgaagacctcaaatatacaagaggacagttcataactaattatggatattagaacattggttcttcattgacatatgcaagtaagtttttaaactcagatatgtttatgggtaatattcacaatttattttgctgaaccctacattagattaggtattatggtctgatgaataggcaaaataatgagactaatttagcagggaaaagaggaactttgtgagattcaaagtattgataatatatatattctttaaaacaggtggtgccaggagagactgcactggcgttttacagagctaagaatcctactgacaaaccagtaattggaatttctacatacaatattgttccatttgaagctggacagtatttcaataaaatacaggtacatcaaagtgtaaactttacagaatatgataaagatacatgaaacggtttagtatgaaacttagtgttttagtagatcttgtgatttctgaaaacgaatttcttctaaacatcaagctatttttcttcactatctatacctgctatgcagagattgagaaccaaaccaaatggatatctgcttttaagattagaatttgttcttcatccttaaagcagaactcattgagatgaaaagatgctcttaatttatcacagaactgtgtatttaatagtatgcttattaaaatcacgaagtgtactggaatgctaagataaaagaactgtatagtttctgttatgtaatacgagaatagaaatgttattaaaatctttctataatttccagtgcttctgttttgaagaacaaaggcttaatccccaagaggaagtagatatgccagtgtttttctacattgatcctgaatttgctgaagatccaagaatgattaaagttgatcttatcactctttcttacactttttttgaagcaaaggaagggcacaagttgccagttccaggatataattgaagtcagcaactaagtcttccttcaaagttgtgatttttgggaaaatcatatatcctatcttctcaaaggagaaatattgtacaataatatgaaggcttatattttaaataattattttttctcaactaatttttttcacttaaacttgagagaacaagttcagcttttatcataagaaactcatatgcctagctagaatatatgactgactattcaataccatactgaagagtttgatactattaaaataagccgctttgttttttaaatatgcaggcatgggttcagcttaattccataattcccttccagattattaactcttcatacttacagcaatgaatctgacaatgtttttcaaaaatgtatgctcagggttatttgtttcaagtcataggccagaacttctaaccatgtttattgtgtctaaaagagttggttgctattttccttcattatgaatagtcagtattttaaaagctcaaagtagaagaggagtcactaagccctaacagcttgtccaaagatttaaattcttatttcaaatttgatttgtcctttaaggtttagggctattttatattcagagttctgaataattactttgaaactgtagtatcataaaattgaaataaaatacatctactaggctgttagccaaagcatcaccattacaagtccatgaatgttaaaatgtacaggtgggattgtgaagatttactgacatcaaaagttcttctggaaacaaacctttgttaaaaaaaaaaagtattaaattgttttaatagtgatttatttgtcatcaaatgtacaacttattctaaatattttcattttctgtgttctaaatagaaatattaagttgcagtaaaaagagaaaaaaaggctatttagcattacaaagaatcatatttaaaggctgcccaatgtagagtctagtgacctgttcaggacacctgaaatataattaaatgacaattatcaaggttttaacaatttataattctaaaccagaggattataaagaagtgcaaattgacttttacattcaactttagttaaatgaaggcactcagtattcttcctgaataatacattcagtttctcacattttatgctttcatctattcagaattatttcatagtaaaataatctactcttatcacagctgtgtgacgatttctaaatgtaggaaggcctgtgaaacatgacactgcagttaaattggttggcctaaggactaagtaatttttcttctgctgaagttttaagtgagtatttgttccaaacaagttctgttgaaatctcacgctgttgtcaggaatcagtgttatcctggaactgttattctatttaatcttcattatagcagaaatgtgccaccatggctttgacatgttggtaggtattgtcttccaggcttcaaagctgcacagagtctacgttttagagagttggcacctttgatgtggtagtgagctgatcatccactttcttctaaaataaagagaagaaaatggccagta

SEQ ID NO: 291739 - DNA, 1306 bp, Homo sapiens
cgactgcaagcgctgccacctgaggagcctggtagccaaggcagcggcaggctcaacccagatctcgcgagacggagcacgcctagcggagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacaggcttcaaagctgcacagagtctacgttttagagagttggcacctttgatgtggtagtgagctgatcatccactttcttctaaaataaagagaagaaaatggccagtattcatcctgtccttctctttccccattccttgataactctcttgtctttactgggaagctggagagtcacagtctagtagaagaaaggtctatagtaaagagatgtggcatctgatgaaaaggaagacaagaagatgcggcagccctacagactacttcaggaagcccaggaagaagatggcatggattagaaaaatttcaactgtaggtgcctttgcaacctatcctgggagaccctaaaacatatttagttttagtgcctagagattttcactcctctaacatctctggatacagtgtccctggtcaacatgaagaagttacagaagaacgctttctgatcctggcccctaaagaatttacttgtgctaagtaataaaattcctattgatcaaaacctgaaaacttgtg

SEQ ID NO: 291740 - DNA, 1215 bp, Homo sapiens
cgactgcaagcgctgccacctgaggagcctggtagccaaggcagcggcaggctcaacccagatctcgcgagacggagcacgcctagcggagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacagctgtgtgacgatttctaaatgtaggaaggcctgtgaaacatgacactgcagttaaattggttggcctaaggactaagtaatttttcttctgctgaagttttaagtctatagtaaagagatgtggcatctgatgaaaaggaagacaagaagatgcggcagccctacagactacttcaggaagcccaggaagaagatggcatggattagaaaaatttcaactgtaggtgcctttgcaacctatcctgggagaccctaaaacatatttagttttagtgcctagagattttcactcctctaacatctctggatacagtgtccctggtcaacatgaagaagttacagaagaacgctttctgatcctggcccctaaagaatttacttgtgctaagtaataaaattcctattgatcaaaacctgaaaacttgtg

SEQ ID NO: 291741 - DNA, 667 bp, Homo sapiens
ggggagaaaaatgcctgttttacaattcatatagctgatttcagatacttttattccttctttacagttgtactccttccatcagagtatgcccgtgggccctcactgacccccaaggtgggtgccaccctgctgatgactccctaggcttatgctgaagcctccaaaagcccctgcagttataagggggcagccaaccagggagccagtattatctgggcgttctaactgtattgacgtgactccttcagatgggtatgagaaacctttgaaaaaatacaccctaaagaattctttgtttatgacatagggttagagggggaaaaaatgaataaataaaataaataaataaataaataaatcaataaaaaaccaaaaccaaaaacaccaaaaaaagaattctctatttccccacagtctatctttgctgacttcattctgaaattcttaaatcagatatgcttcttgtcctttttctccatagaagacttaattgatttatttcagatcaaccatagtggagttatttagatgtaaaaaaaaaattatttgtcaaaagaaattaagaatagcactccccacaccagatctttatatgtcactaacaaaaagtatacaaagaaaaataacattccacattcaacagtctctataaacaagttgatcc

SEQ ID NO: 291742 - DNA, 2810 bp, Homo sapiens
cgactgcaagcgctgccacctgaggagcctggtagccaaggcagcggcaggctcaacccagatctcgcgagacggagcacgcctagcggagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacagtgcttctgttttgaagaacaaaggcttaatccccaagaggaagtagatatgccagtgtttttctacattgatcctgaatttgctgaagatccaagaatgattaaagttgatcttatcactctttcttacactttttttgaagcaaaggaagggcacaagttgccagttccaggatataattgaagtcagcaactaagtcttccttcaaagttgtgatttttgggaaaatcatatatcctatcttctcaaaggagaaatattgtacaataatatgaaggcttatattttaaataattattttttctcaactaatttttttcacttaaacttgagagaacaagttcagcttttatcataagaaactcatatgcctagctagaatatatgactgactattcaataccatactgaagagtttgatactattaaaataagccgctttgttttttaaatatgcaggcatgggttcagcttaattccataattcccttccagattattaactcttcatacttacagcaatgaatctgacaatgtttttcaaaaatgtatgctcagggttatttgtttcaagtcataggccagaacttctaaccatgtttattgtgtctaaaagagttggttgctattttccttcattatgaatagtcagtattttaaaagctcaaagtagaagaggagtcactaagccctaacagcttgtccaaagatttaaattcttatttcaaatttgatttgtcctttaaggtttagggctattttatattcagagttctgaataattactttgaaactgtagtatcataaaattgaaataaaatacatctactaggctgttagccaaagcatcaccattacaagtccatgaatgttaaaatgtacaggtgggattgtgaagatttactgacatcaaaagttcttctggaaacaaacctttgttaaaaaaaaaaagtattaaattgttttaatagtgatttatttgtcatcaaatgtacaacttattctaaatattttcattttctgtgttctaaatagaaatattaagttgcagtaaaaagagaaaaaaaggctatttagcattacaaagaatcatatttaaaggctgcccaatgtagagtctagtgacctgttcaggacacctgaaatataattaaatgacaattatcaaggttttaacaatttataattctaaaccagaggattataaagaagtgcaaattgacttttacattcaactttagttaaatgaaggcactcagtattcttcctgaataatacattcagtttctcacattttatgctttcatctattcagaattatttcatagtaaaataatctactcttatcacagctgtgtgacgatttctaaatgtaggaaggcctgtgaaacatgacactgcagttaaattggttggcctaaggactaagtaatttttcttctgctgaagttttaagtgagtatttgttccaaacaagttctgttgaaatctcacgctgttgtcaggaatcagtgttatcctggaactgttattctatttaatcttcattatagcagaaatgtgccaccatggctttgacatgttggtaggtattgtcttccaggcttcaaagctgcacagagtctacgttttagagagttggcacctttgatgtggtagtgagctgatcatccactttcttctaaaataaagagaagaaaatggccagtattcatcctgtccttctctttccccattccttgataactctcttgtctttactgggaagctggagagtcacagtctagtagaagaaagattagaaaaatttcaactgtaggtgcctttgcaacctatcctgggagaccctaaaacatatttagttttagtgcctagagattttcactcctctaacatctctggatacagtgtccctggtcaacatgaagaagttacagaagaacgctttctgatcctggcccctaaagaatttacttgtgctaagtaataaaattcctattgatcaaaacctgaaaacttgtg

SEQ ID NO: 291743 - DNA, 949 bp, Homo sapiens
ggagaaagaggttttgctcgggtctatgtgttttttaaaactgttgacttgtataactggaaatcccatagtaagggcttatgggtgagcccacgagagttcgtaactctcatatggagaatattctccacacataaccctacctggccaggtgtgcagaccgtaacagcaaccctgctcacagcagaagataaatctgccaccatggccaaaactaaggaggaggcagacaatatgtgtgctgataacctggtgacctggcccgttgaggtgtcagtcccaatagccaacccaaactgggaccccagtgataacaagaatcaagagtggcttcatcattataggaatatgcttctcagaggtatgagggaagcaagccagtccctggtcaattggggaaatctcagagaaatagaacaaggccctaatgaaaatccatcagcattcctaaattgataataagaatgcctccagaattacaccccttgggacccagatgacccaaaagctgagtagtactttaatctcacttcatctctcagccccagatattcagagaaaactctaaaaagtggcaataaatccacatactccccctttccaactggtagacatctcctttaaggtctatagtaaagagatgtggcatctgatgaaaaggaagacaagaagatgcggcagccctacagactacttcaggaagcccaggaagaagatggcatggattagaaaaatttcaactgtaggtgcctttgcaacctatcctgggagaccctaaaacatatttagttttagtgcctagagattttcactcctctaacatctctggatacagtgtccctggtcaacatgaagaagttacagaagaacgctttctgatcctggcccctaaagaatttacttgtgctaagtaataaaattcctattgatcaaaacctgaaaacttgtg

SEQ ID NO: 291744 - DNA, 1765 bp, Homo sapiens
cgactgcaagcgctgccacctgaggagcctggtagccaaggcagcggcaggctcaacccagatctcgcgagacggagcacgcctagcggagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacagtgcttctgttttgaagaacaaaggcttaatccccaagaggaagtagatatgccagtgtttttctacattgatcctgaatttgctgaagatccaagaatgattaaagttgatcttatcactctttcttacactttttttgaagcaaaggaagggcacaagttgccagttccaggatataattgaagtcagcaactaagtcttccttcaaagttgtgatttttgggaaaatcatatatcctatcttctcaaaggagaaatattgtacaataatatgaaggcttatattttaaataattattttttctcaactaatttttttcacttaaacttgagagaacaagttcagcttttatcataagaaactcatatgcctagctagaatatatgactgactattcaataccatactgaagagtttgatactattaaaataagccgctttgttttttaaatatgcaggcatgggttcagcttaattccataattcccttccagattattaactcttcatacttacagcaatgaatctgacaatgtttttcaaaaatgtatgctcagggttatttgtttcaagtcataggccagaacttctaaccatgtttattgtgtctaaaagagttggttgctattttccttcattatgaatagtcagtattttaaaagctcaaagtagaagaggagtcactaagccctaacagcttgtccaaagatttaaattcttatttcaaatttgatttgtcctttaaggtttagggctattttatattcagagttctgaataattactttgaaactgtagtatcataaaattgaaataaaatacatctactaggctgttagccaaagcatcaccattacaagtccatgaatgttaaaatgtacaggtgggattgtgaagatttactgacatcaaaagttcttctggaaacaaacctttgttaaaaaaaaaaagtattaaattgttttaatagtgattt

SEQ ID NO: 291745 - DNA, 2909 bp, Homo sapiens
cgactgcaagcgctgccacctgaggagcctggtagccaaggcagcggcaggctcaacccagatctcgcgagacggagcacgcctagcggagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacagtgcttctgttttgaagaacaaaggcttaatccccaagaggaagtagatatgccagtgtttttctacattgatcctgaatttgctgaagatccaagaatgattaaagttgatcttatcactctttcttacactttttttgaagcaaaggaagggcacaagttgccagttccaggatataattgaagtcagcaactaagtcttccttcaaagttgtgatttttgggaaaatcatatatcctatcttctcaaaggagaaatattgtacaataatatgaaggcttatattttaaataattattttttctcaactaatttttttcacttaaacttgagagaacaagttcagcttttatcataagaaactcatatgcctagctagaatatatgactgactattcaataccatactgaagagtttgatactattaaaataagccgctttgttttttaaatatgcaggcatgggttcagcttaattccataattcccttccagattattaactcttcatacttacagcaatgaatctgacaatgtttttcaaaaatgtatgctcagggttatttgtttcaagtcataggccagaacttctaaccatgtttattgtgtctaaaagagttggttgctattttccttcattatgaatagtcagtattttaaaagctcaaagtagaagaggagtcactaagccctaacagcttgtccaaagatttaaattcttatttcaaatttgatttgtcctttaaggtttagggctattttatattcagagttctgaataattactttgaaactgtagtatcataaaattgaaataaaatacatctactaggctgttagccaaagcatcaccattacaagtccatgaatgttaaaatgtacaggtgggattgtgaagatttactgacatcaaaagttcttctggaaacaaacctttgttaaaaaaaaaaagtattaaattgttttaatagtgatttatttgtcatcaaatgtacaacttattctaaatattttcattttctgtgttctaaatagaaatattaagttgcagtaaaaagagaaaaaaaggctatttagcattacaaagaatcatatttaaaggctgcccaatgtagagtctagtgacctgttcaggacacctgaaatataattaaatgacaattatcaaggttttaacaatttataattctaaaccagaggattataaagaagtgcaaattgacttttacattcaactttagttaaatgaaggcactcagtattcttcctgaataatacattcagtttctcacattttatgctttcatctattcagaattatttcatagtaaaataatctactcttatcacagctgtgtgacgatttctaaatgtaggaaggcctgtgaaacatgacactgcagttaaattggttggcctaaggactaagtaatttttcttctgctgaagttttaagtgagtatttgttccaaacaagttctgttgaaatctcacgctgttgtcaggaatcagtgttatcctggaactgttattctatttaatcttcattatagcagaaatgtgccaccatggctttgacatgttggtaggtattgtcttccaggcttcaaagctgcacagagtctacgttttagagagttggcacctttgatgtggtagtgagctgatcatccactttcttctaaaataaagagaagaaaatggccagtattcatcctgtccttctctttccccattccttgataactctcttgtctttactgggaagctggagagtcacagtctagtagaagaaaggtctatagtaaagagatgtggcatctgatgaaaaggaagacaagaagatgcggcagccctacagactacttcaggaagcccaggaagaagatggcatggattagaaaaatttcaactgtaggtgcctttgcaacctatcctgggagaccctaaaacatatttagttttagtgcctagagattttcactcctctaacatctctggatacagtgtccctggtcaacatgaagaagttacagaagaacgctttctgatcctggcccctaaagaatttacttgtgctaagtaataaaattcctattgatcaaaacctgaaaacttgtg

SEQ ID NO: 291746 - DNA, 2444 bp, Homo sapiens
cgactgcaagcgctgccacctgaggagcctggtagccaaggcagcggcaggctcaacccagatctcgcgagacggagcacgcctagcggagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacagtgcttctgttttgaagaacaaaggcttaatccccaagaggaagtagatatgccagtgtttttctacattgatcctgaatttgctgaagatccaagaatgattaaagttgatcttatcactctttcttacactttttttgaagcaaaggaagggcacaagttgccagttccaggatataattgaagtcagcaactaagtcttccttcaaagttgtgatttttgggcttatattttaaataattattttttctcaactaatttttttcacttaaacttgagagaacaagttcagcttttatcataagaaactcatatgcctagctagaatatatgactgactattcaataccatactgaagagtttgatactattaaaataagccgctttgttttttaaatatgcaggcatgggttcagcttaattccataattcccttccagattattaactcttcatacttacagcaatgaatctgacaatgtttttcaaaaatgtatgctcagggttatttgtttcaagtcataggccagaacttctaaccatgtttattgtgtctaaaagagttggttgctattttccttcattatgaatagtcagtattttaaaagctcaaagtagaagaggagtcactaagccctaacagcttgtccaaagatttaaattcttatttcaaatttgatttgtcctttaaggtttagggctattttatattcagagttctgaataattactttgaaactgtagtatcataaaattgaaataaaatacatctactaggctgttagccaaagcatcaccattacaagtccatgaatgttaaaatgtacaggtgggattgtgaagatttactgacatcaaaagttcttctggaaacaaacctttgttaaaaaaaaaaagtattaaattgttttaatagtgatttatttgtcatcaaatgtacaacttattctaaatattttcattttctgtgttctaaatagaaatattaagttgcagtaaaaagagaaaaaaaggctatttagcattacaaagaatcatatttaaaggctgcccaatgtagagtctagtgacctgttcaggacacctgaaatataattaaatgacaattatcaaggttttaacaatttataattctaaaccagaggattataaagaagtgcaaattgacttttacattcaactttagttaaatgaaggcactcagtattcttcctgaataatacattcagtttctcacattttatgctttcatctattcagaattatttcatagtaaaataatctactcttatcacagctgtgtgacgatttctaaatgtaggaaggcctgtgaaacatgacactgcagttaaattggttggcctaaggactaagtaatttttcttctgctgaagttttaagtgagtatttgttccaaacaagttctgttgaaatctcacgctgttgtcaggaatcagtgttatcctggaactgttattctatttaatcttcattatagcagaaatgtgccaccatggctttgacatgttggtaggtattgtcttccaggcttcaaagctgcacagagtctacgttttagagagttggcacctttgatgtggtagtgagctgatcatccactttcttctaaaataaagagaagaaaatggccagta

SEQ ID NO: 291747 - DNA, 1254 bp, Homo sapiens
cgactgcaagcgctgccacctgaggagcctggtagccaaggcagcggcaggctcaacccagatctcgcgagacggagcacgcctagcggagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacagagattcctagattcttttggaaaccagcagttatttggaggagagtccttttttctggccttgacagccaccctggaagttccctgctcctgacttagcggctcagacagcagaggacagaggacagttgttttccttaccatttgtactccttccatcagagtatgcccgtgggccctcactgacccccaaggtgggtgccaccctgctgatgactccctaggcttatgctgaagcctccaaaagcccctgcagttataagggggcagccaaccagggagccagtattatctgggcgttctaactgtattgacgtgactccttcagatgggtatgagaaacctttgaaaaaatacaccctaaagaattctttgtttatgacatagggttagagggggaaaaaatgaataaataaaataaataaataaataaataaatcaataaaaaaccaaaaccaaaaacacca

SEQ ID NO: 291748 - DNA, 2490 bp, Homo sapiens
gagatgaggtttcaccatgttggccaggctggtcttgaactcccagcctcaagtgattcacctgcctgtacctcccaaagtgctgggattaaaggcgtgagccactgcacccagcctcagattgtatttattttaaaacctattacttactttgcaaagctcttttacataccttgtgttatttgattccaacaactcagagcggtccagtaggatggataatgttcttattttacagatgaggaaactgagatacaggaaggtgagttacagaactctggctactgttctgctcatctcccagccccgtgaattttcatctctctcttcccccagtttatttatggagattcttagttcctgttcagattgtgatgagatccaattcatggaagatggatcctggtgcccaatgaaacccaagaaggaggcatctgaggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaaggagtcctgacatctggccaccagccatcctcggtgctaaggagccctgctatgggcacgttgggtggggatttcctgtccagtctcccactacatgagtacccacctgccttcccactgggagccgacatccaaggtttagatttattttcatttcttcagacagagagtcaggtaagtggttctttcttcagaaggtctcagatctctgaagcttcctttctagacactgatggggcccctccctctcttatgatctctggggatgtaaatctgctttcccgtgagggcagtggggtgtaggtatcttattatctcctcagccccactggtagttcctgagattcctacttaggcctccttcctagatcccctgttacttttctgccctggcctactcacccctacccccgtgtgcacttagagcaccatgcctgctctaaccggacattccacacatttcagacgcccacaaagccaagaacctaacaagttggaggagctctctcaaggcagggaaaggggaagggtgtagggaagtaggggaaagagggagaggctctcctgcttctcaagagaataccttcggatccacaggggttgattgctctcatacggcatttctgagatgagtgactgggaggtggggaagtcgggattgagatcttaaactatgcccttgattcttcctagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctctatttatatatctaagttcacagtgtttcttattcccccctaagcttctagaggctcatggccctgtagttaggcctggctcattctgcacctttccagggaggtggaaggaccctgtgccctccttcccaatcttctttttcaggctcgccaaggcctaggacctatgttgtaattttactttttatttctaaagttgtagtgaagctctcacccataataaaggttgtgaatgttc

SEQ ID NO: 291749 - DNA, 1639 bp, Homo sapiens
atatgggctctccggactggaaagaatcttaggggtcctctaatctaaccctcacatgatgcttcaactcctccagatcatctctaacatagccagagtgtcacgctatgtttaagcatcttcagggatgggaaaatcccccacacccagccttcatcatccatatcccagaccacttccatgtgacgtcccactggcccccaaagacgctccacccagcagcctctcagccagagccatctgttcctggccttaccaactcctgggcttcctccagccttgctgaccccatggctctggcctcacttttgtttcagtcaaggagaaattgactgctgaccctgacagtgaggtggccactacaagtctccgggtgtcactcatgtgcccggtgggtaaaaggggagaagggaacagggtgggaagggagttgggtttagcctgtggactttgatgagggttcctagggatactggcgtgaagttttctgggatgaaatcagagtagggcctctgacaagagaacttgcttctcctcagctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatgggtagggccattttgcttcctcttacctgggacatccactagaacctcttttcttggttatttctttttctttttcttttcttttttttttttttgagatggaatcttactctgttccccaggctggagtgcagtggcacaatcttggctcactgcaacctccacctcccgggttcaggcgatactcctgcctcagcctcctgagtagctgggattacaggcacccaccaccatgcctggctaatttttgtatttttagtaaagactgggtttcaccatgttggccaggctggtcttgaactcctgacctcaggtgatctgcccacttcagcctcctaaagtgctgggattacaggcatgagacaacatgcccagcctataatatttcttttttcttttagccaccacctccttcagggtttttaattcatatggcttacttcccctcacatgaactgcaattctcaccttatctatcccttttaccagtctgtgtgtgtgtgtgtgtatgtgcatgtgtgtggagggggagggcaacattaaggacttagtatatacaaggcatcttgctgagcactttgcatgagttatctcattgaatcctcacaataaccctatggactcggctcctacctgtaattccaacactggaaggctgagatgggaagatcatttgaggctgggagtttgagaccagcctgggcaacatggtagaccctctctctataaaaaattaaaaaaattagccaggcatgttataatagctcatgactgtagtcttagctgctcaggaggctgaggcgggaggatggcttgaacccaggagtttgaggctgcagtgagctatgattgcattactgcaccccagcctgggcaacagattgagaccctgtctcaaaaaaagaaataatcctatgattggctagtgacactcacccag

SEQ ID NO: 291750 - DNA, 2923 bp, Homo sapiens
cggccgccgcgtccggctgctggaccgaacttctgccgtgcggacagcaggagcagcgccgagccccattcccccacctctccagctcgccctctgagcctcccgagccctctctccatttcccacaattgtgctgcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacggaattactccttgtctgtgtacctggtgaggcagttgactgcaggaacccttctacaaaaactcagagcaaagggtatccggaacccagaccactcgcgggcactgatcaaggagaaattgactgctgaccctgacagtgaggtggccactacaagtctccgggtgtcactcatgtgcccgctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatggtttatttatggagattcttagttcctgttcagattgtgatgagatccaattcatggaagatggatcctggtgcccaatgaaacccaagaaggaggcatctgaggtttgccccccgccagggtatgggctggatggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaaggagtcctgacatctggccaccagccatcctcggtgctaaggagccctgctatgggcacgttgggtggggatttcctgtccagtctcccactacatgagtacccacctgccttcccactgggagccgacatccaaggtttagatttattttcatttcttcagacagagagtcagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctctatttatatatctaagttcacagtgtttcttattcccccctaagcttctagaggctcatggccctgtagttaggcctggctcattctgcacctttccagggaggtggaaggaccctgtgccctccttcccaatcttctttttcaggctcgccaaggcctaggacctatgttgtaattttactttttatttctaaagttgtagtgaagctctcacccataataaaggttgtgaatgttc

SEQ ID NO: 291751 - DNA, 3021 bp, Homo sapiens
ggcatttgcggccggcgccagggtggagagttgtgcgccggtccctgggcctgagctccggctccggctggggcgcctgcgatgtctcaagatggcggagctgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacggaattactccttgtctgtgtacctggtgaggcagttgactgcaggaacccttctacaaaaactcagagcaaagggtatccggaacccagaccactcgcgggcactgatcaaggagaaattgactgctgaccctgacagtgaggtggccactacaagtctccgggtgtcactcatgtgcccgctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatggtttatttatggagattcttagttcctgttcagattgtgatgagatccaattcatggaagatggatcctggtgcccaatgaaacccaagaaggaggcatctgaggtttgccccccgccagggtatgggctggatggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaaggagtcctgacatctggccaccagccatcctcggtgctaaggagccctgctatgggcacgttgggtggggatttcctgtccagtctcccactacatgagtacccacctgccttcccactgggagccgacatccaaggtttagatttattttcatttcttcagacagagagtcagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctctatttatatatctaagttcacagtgtttcttattcccccctaagcttctagaggctcatggccctgtagttaggcctggctcattctgcacctttccagggaggtggaaggaccctgtgccctccttcccaatcttctttttcaggctcgccaaggcctaggacctatgttgtaattttactttttatttctaaagttgtagtgaagctctcacccataataaaggttgtgaatgttcaaaaaaaaaaaaaaaaattttgggggggggccggcccccaattcccctttaggggaggtgtataacaatcttgcggccggcatttaaaacctcagggatggagaaaacccggcggaacc

SEQ ID NO: 291752 - DNA, 2990 bp, Homo sapiens
ggcatttgcggccggcgccagggtggagagttgtgcgccggtccctgggcctgagctccggctccggctggggcgcctgcgatgtctcaagatggcggagctgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacggaattactccttgtctgtgtacctggtgaggcagttgactgcaggaacccttctacaaaaactcagagcaaagggtatccggaacccagaccactcgcgggcactgatcaaggagaaattgactgctgaccctgacagtgaggtggccactacaagtctccgggtgtcactcatgtgcccgctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatggtttatttatggagattcttagttcctgttcagattgtgatgagatccaattcatggaagatggatcctggtgcccaatgaaacccaagaaggaggcatctgaggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaaggagtcctgacatctggccaccagccatcctcggtgctaaggagccctgctatgggcacgttgggtggggatttcctgtccagtctcccactacatgagtacccacctgccttcccactgggagccgacatccaaggtttagatttattttcatttcttcagacagagagtcagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctctatttatatatctaagttcacagtgtttcttattcccccctaagcttctagaggctcatggccctgtagttaggcctggctcattctgcacctttccagggaggtggaaggaccctgtgccctccttcccaatcttctttttcaggctcgccaaggcctaggacctatgttgtaattttactttttatttctaaagttgtagtgaagctctcacccataataaaggttgtgaatgttcaaaaaaaaaaaaaaaaattttgggggggggccggcccccaattcccctttaggggaggtgtataacaatcttgcggccggcatttaaaacctcagggatggagaaaacccggcggaacc

SEQ ID NO: 291753 - DNA, 702 bp, Homo sapiens
ctcggctctaccttgtctctcggctctaccattgtctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctctatttatatatctaagttcacagtgtttcttattcccccctaagcttctagaggctcatggccctgtagttaggcctggctcattctgcacctttccagggaggtggaaggaccctgtgccctccttcccaatcttctttttcaggctcgccaaggcctaggacctatgttgtaattttactttttatttctaaagttgtagtgaagctctcacccataataaaggttgtgaatgttcaaaaaaaaaaaaaaaaattttgggggggggccggcccccaattcccctttaggggaggtgtataacaatcttgcggccggcatttaaaacctcagggatggagaaaacccggcggaacc

SEQ ID NO: 291754 - DNA, 2175 bp, Homo sapiens
ggcatttgcggccggcgccagggtggagagttgtgcgccggtccctgggcctgagctccggctccggctggggcgcctgcgatgtctcaagatggcggagctgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacggaattactccttgtctgtgtacctggtgaggcagttgactgcaggaacccttctacaaaaactcagagcaaagggtatccggaacccagaccactcgcgggcactgatcaaggagaaattgactgctgaccctgacagtgaggtggccactacaagtctccgggtgtcactcatgtgcccgctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatgggtagggccattttgcttcctcttacctgggacatccactagaacctcttttcttggttatttctttttctttttcttttcttttttttttttttgagatggaatcttactctgttccccaggctggagtgcagtggcacaatcttggctcactgcaacctccacctcccgggttcaggcgatactcctgcctcagcctcctgagtagctgggattacaggcacccaccaccatgcctggctaatttttgtatttttagtaaagactgggtttcaccatgttggccaggctggtcttgaactcctgacctcaggtgatctgcccacttcagcctcctaaagtgctgggattacaggcatgagacaacatgcccagcctataatatttcttttttcttttagccaccacctccttcagggtttttaattcatatggcttacttcccctcacatgaactgcaattctcaccttatctatcccttttaccagtctgtgtgtgtgtgtgtgtatgtgcatgtgtgtggagggggagggcaacattaaggacttagtatatacaaggcatcttgctgagcactttgcatgagttatctcattgaatcctcacaataaccctatggactcggctcctacctgtaattccaacactggaaggctgagatgggaagatcatttgaggctgggagtttgagaccagcctgggcaacatggtagaccctctctctataaaaaattaaaaaaattagccaggcatgttataatagctcatgactgtagtcttagctgctcaggaggctgaggcgggaggatggcttgaacccaggagtttgaggctgcagtgagctatgattgcattactgcaccccagcctgggcaacagattgagaccctgtctcaaaaaaagaaataatcctatgattggctagtgacactcacccag

SEQ ID NO: 291755 - DNA, 867 bp, Homo sapiens
ggcatttgcggccggcgccagggtggagagttgtgcgccggtccctgggcctgagctccggctccggctggggcgcctgcgatgtctcaagatggcggagctgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttggtatggctctttgtggtcccttagtcttctggactccctacctgttccccaaacatttcttaggctttagtcctatgggatcagtgacctgggatgggggcgatttctgtggctgcctgtgcatgggcttggaataactgcccctttgtatcctcagcatccacttctagccagcggtttgaggaagcgcactttacctttgccctcacaccccagcaagtgcagcagattcttacatccagacgttgtccttttcccctggttctaggaacttttgactggagagaatcacagatgtggaatatttgtcataaataaataatgaaaacctaaa

SEQ ID NO: 291756 - DNA, 242 bp, Homo sapiens
cccaaccaagaatggggccgagcccaagaggcccagccgccccatcaacatcacacccctggctcgactctcagccactgttcccaacaccattgtggtcaattggtcatctgagttcggacgggtgagcacagctaaagcaggtgcctggaaaagcctgctgagggtgaaggggaaccatccagtgtcctgggttggggaagcattttcctctttatgagtctgtctctggtcctcatgga

SEQ ID NO: 291757 - DNA, 2902 bp, Homo sapiens
ggcatttgcggccggcgccagggtggagagttgtgcgccggtccctgggcctgagctccggctccggctggggcgcctgcgatgtctcaagatggcggagctgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacggaattactccttgtctgtgtacctggtgaggcagttgactgcaggaacccttctacaaaaactcagagcaaagggtatccggaacccagaccactcgcgggcactgatcaaggagaaattgactgctgaccctgacagtgaggtggccactacaagtctccgggtgtcactcatgtgcccgctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatggtttatttatggagattcttagttcctgttcagattgtgatgagatccaattcatggaagatggatcctggtgcccaatgaaacccaagaaggaggcatctgaggtttgccccccgccagggtatgggctggatggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaaggagtcctgacatctggccaccagccatcctcggtgctaaggagccctgctatgggcacgttgggtggggatttcctgtccagtctcccactacatgagtacccacctgccttcccactgggagccgacatccaaggtttagatttattttcatttcttcagacagagagtcagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctctatttatatatctaagttcacagtgtttcttattcccccctaagcttctagaggctcatggccctgtagttaggcctggctcattctgcacctttccagggaggtggaaggaccctgtgccctccttcccaatcttctttttcaggctcgccaaggcctaggacctatgttgtaattttactttttatttctaaagttgtagtgaagctctcacccataataaaggttgtgaatgttc

SEQ ID NO: 291758 - DNA, 3059 bp, Homo sapiens
ggcatttgcggccggcgccagggtggagagttgtgcgccggtccctgggcctgagctccggctccggctggggcgcctgcgatgtctcaagatggcggagctgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttggtatggctctttgtggtcccttagtcttctggactccctacctgttccccaaacatttcttaggctttagtcctatgggatcagtgacctgggatgggggcgatttctgtggctgcctgtgcatgggcttggaataactgcccctttgtatcctcagcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacggaattactccttgtctgtgtacctggtgaggcagttgactgcaggaacccttctacaaaaactcagagcaaagggtatccggaacccagaccactcgcgggcactgatcaaggagaaattgactgctgaccctgacagtgaggtggccactacaagtctccgggtgtcactcatgtgcccgctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatggtttatttatggagattcttagttcctgttcagattgtgatgagatccaattcatggaagatggatcctggtgcccaatgaaacccaagaaggaggcatctgaggtttgccccccgccagggtatgggctggatggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaaggagtcctgacatctggccaccagccatcctcggtgctaaggagccctgctatgggcacgttgggtggggatttcctgtccagtctcccactacatgagtacccacctgccttcccactgggagccgacatccaaggtttagatttattttcatttcttcagacagagagtcagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctctatttatatatctaagttcacagtgtttcttattcccccctaagcttctagaggctcatggccctgtagttaggcctggctcattctgcacctttccagggaggtggaaggaccctgtgccctccttcccaatcttctttttcaggctcgccaaggcctaggacctatgttgtaattttactttttatttctaaagttgtagtgaagctctcacccataataaaggttgtgaatgttc

SEQ ID NO: 291759 - DNA, 1260 bp, Homo sapiens
ggcatttgcggccggcgccagggtggagagttgtgcgccggtccctgggcctgagctccggctccggctggggcgcctgcgatgtctcaagatggcggagctgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacggaattactccttgtctgtgtacctggtgaggcagttgactgcaggaacccttctacaaaaactcagagcaaagggtatccggaacccagaccactcgcgggcactgatcaaggagaaattgactgctgaccctgacagtgaggtggccactacaagtctccgggtgtcactcatgtgcccgctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatggaagcgtcgcgcatgggtaccgagc

SEQ ID NO: 291760 - DNA, 990 bp, Homo sapiens
  misc_feature (944)..(944): n is a, c, g, or t
  misc_feature (951)..(951): n is a, c, g, or t
ggcatttgcggccggcgccagggtggagagttgtgcgccggtccctgggcctgagctccggctccggctggggcgcctgcgatgtctcaagatggcggagctgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttggtatggctctttgtggtcccttagtcttctggactccctacctgttccccaaacatttcttaggctttagtcctatgggatcagtgacctgggatgggggcgatttctgtggctgcctgtgcatgggcttggaataactgcccctttgtatcctcagcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggtacctttcccaaccagaatgggccnagccaanaggccagccgccataacataaccctggttgatttaagca

SEQ ID NO: 291761 - DNA, 650 bp, Homo sapiens
ggcatttgcggccggcgccagggtggagagttgtgcgccggtccctgggcctgagctccggctccggctggggcgcctgcgatgtctcaagatggcggagctgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagccagcaaagaaccacacgccaaacaagaacca

SEQ ID NO: 291762 - DNA, 208 bp, Homo sapiens
aaaacagatactgcgcttccagagcgcagtatacggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctca

SEQ ID NO: 291763 - DNA, 682 bp, Homo sapiens
  misc_feature (13)..(13): n is a, c, g, or t
  misc_feature (20)..(20): n is a, c, g, or t
taattcggcacgngggcacnagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcaggtgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagc

SEQ ID NO: 291764 - DNA, 2410 bp, Homo sapiens
aaggagggaggcggagctcgtactcaagagccgcctcccgggcggctggggcggtccccgagctgctttccgcgttctcccctctccgcgggcagtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagcttatcttccttgccagattttaaaaactattatggaaaatctcaagcattcacaaaagtagagagaaagaaaggactctcagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaaggtgaatggattctctaacaactactggggatggggaggcgaagacgatgacctcagactcagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctggatcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcaggtgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagc

SEQ ID NO: 291765 - DNA, 2327 bp, Homo sapiens
aaggagggaggcggagctcgtactcaagagccgcctcccgggcggctggggcggtccccgagctgctttccgcgttctcccctctccgcgggcagtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaaggtgaatggattctctaacaactactggggatggggaggcgaagacgatgacctcagactcagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctggatcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcaggtgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagc

SEQ ID NO: 291766 - DNA, 2816 bp, Homo sapiens
aaggagggaggcggagctcgtactcaagagccgcctcccgggcggctggggcggtccccgagctgctttccgcgttctcccctctccgcgggcagtgctagctcgccgcggccgcctccggggtgagtacgctggctccgccggcgcccgggaaatgcagttccctggacacgggcgccgtgcgagggtagccgggcgacggccggggtcagtcccagggctgtagcggggcgggcgtggggatgacgtggcggcgtccgtggggcagtcccgcctcagccggagcggtgggccgggccgggggcctacggaggccgagcctggcgggaggcaccggctcaggtgctggcgttccgcgcggcgccgcctctgctgcgggccgggggagccagacgaggtgctgccgggtaggaaaaaatccagggctcattcataccccaggtcacgattccggggtcgcccccagcacttctccgccgggtgcatcaacctgaaaaagccccttcttcctggaaaccctccttctccagcgtttcaacggggaaactgatcagctgacaccagccccagtcctgcgaggggccggcgacctttgacctttctccaaaggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaaggtgaatggattctctaacaactactggggatggggaggcgaagacgatgacctcagactcagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctggatcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcaggtgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagc

SEQ ID NO: 291767 - DNA, 2265 bp, Homo sapiens
aaggagggaggcggagctcgtactcaagagccgcctcccgggcggctggggcggtccccgagctgctttccgcgttctcccctctccgcgggcagtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctggatcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcaggtgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagc

SEQ ID NO: 291768 - DNA, 2329 bp, Homo sapiens
  misc_feature (2302)..(2302): n is a, c, g, or t
  misc_feature (2314)..(2314): n is a, c, g, or t
aaggagggaggcggagctcgtactcaagagccgcctcccgggcggctggggcggtccccgagctgctttccgcgttctcccctctccgcgggcagtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaaggtgaatggattctctaacaactactggggatggggaggcgaagacgatgacctcagactcagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctggatcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcaggtgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatggttatcccatncagaattaatcntcagtaactggatgg

SEQ ID NO: 291769 - DNA, 2356 bp, Homo sapiens
aaggagggaggcggagctcgtactcaagagccgcctcccgggcggctggggcggtccccgagctgctttccgcgttctcccctctccgcgggcagtgctagctcgccgcggccgcctccggggtgagtacgctggctccgccggcgcccgggaaatgcagttccctggacacgggcgccgtgcgagggtagccgggcgacggccggggtcagtcccagggctgtagcggggcgggcgtggggatgacgtggcggcgtccgtggggcagtcccgcctcagccggagcggtgggccgggccgggggcctacggaggccgagcctggcgggaggcaccggctcaggtgctggcgttccgcgcggcgccgcctctgctgcgggccgggggagccagacgaggtgctgccgggtaggaaaaaatccagggctcattcataccccaggtcacgattccggggtcgcccccagcacttctccgccgggtgcatcaacctgaaaaagccccttcttcctggaaaccctccttctccagcgtttcaacggggaaactgatcagctgacaccagccccagtcctgcgaggggccggcgacctttgacctttctccaaaggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaaggaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctggatcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcaggtgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagc

SEQ ID NO: 291770 - DNA, 1243 bp, Homo sapiens
aaggagggaggcggagctcgtactcaagagccgcctcccgggcggctggggcggtccccgagctgctttccgcgttctcccctctccgcgggcagtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcaggtgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagc

SEQ ID NO: 291771 - DNA, 1014 bp, Homo sapiens
aaggagggaggcggagctcgtactcaagagccgcctcccgggcggctggggcggtccccgagctgctttccgcgttctcccctctccgcgggcagtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagttccgtcgaagccgtcggggatcctcta

SEQ ID NO: 291772 - DNA, 1143 bp, Homo sapiens
aaggagggaggcggagctcgtactcaagagccgcctcccgggcggctggggcggtccccgagctgctttccgcgttctcccctctccgcgggcagtgctagctcgccgcggccgcctccggggtgagtacgctggctccgccggcgcccgggaaatgcagttccctggacacgggcgccgtgcgagggtagccgggcgacggccggggtcagtcccagggctgtagcggggcgggcgtggggatgacgtggcggcgtccgtggggcagtcccgcctcagccggagcggtgggccgggccgggggcctacggaggccgagcctggcgggaggcaccggctcaggtgctggcgttccgcgcggcgccgcctctgctgcgggccgggggagccagacgaggtgctgccgggtaggaaaaaatccagggctcattcataccccaggtcacgattccggggtcgcccccagcacttctccgccgggtgcatcaacctgaaaaagccccttcttcctggaaaccctccttctccagcgtttcaacggggaaactgatcagctgacaccagccccagtcctgcgaggggccggcgacctttgacctttctccaaaggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagaaaagaggggagaaaaggcgacgaatcaggacacagtgaacttgggaatgaagaggtagcaggagggtggagtgtcggctgcaaaggcagcagtagctgagctggttgcaggtgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagc

SEQ ID NO: 291773 - DNA, 1408 bp, Homo sapiens
aaggagggaggcggagctcgtactcaagagccgcctcccgggcggctggggcggtccccgagctgctttccgcgttctcccctctccgcgggcagtgctagctcgccgcggccgcctccggggtgagtacgctggctccgccggcgcccgggaaatgcagttccctggacacgggcgccgtgcgagggtagccgggcgacggccggggtcagtcccagggctgtagcggggcgggcgtggggatgacgtggcggcgtccgtggggcagtcccgcctcagccggagcggtgggccgggccgggggcctacggaggccgagcctggcgggaggcaccggctcaggtgctggcgttccgcgcggcgccgcctctgctgcgggccgggggagccagacgaggtgctgccgggtaggaaaaaatccagggctcattcataccccaggtcacgattccggggtcgcccccagcacttctccgccgggtgcatcaacctgaaaaagccccttcttcctggaaaccctccttctccagcgtttcaacggggaaactgatcagctgacaccagccccagtcctgcgaggggccggcgacctttgacctttctccaaaggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagtaagtgttgcttttttcctttgattaagtagtatgcaaactttttatttaagtataatatgtacttgcctgtatcaaaacatctcatgtaccccataaatatatatatctcctgtgtcacaaaaactatacattcaaataaaataaatataacatgtacaagaaagtacaaaactcagaa

SEQ ID NO: 291774 - DNA, 546 bp, Homo sapiens
ctccctgacacctcacccgacttcctcatgaagttaggtctcccttcattcatcctcatctacatacattctaatttttttggaggctcgtgaaagctatgtacccacctacagacaaactttccttataacataggaagattcagagatcccctgaagctcagccaaggatcagttagcaatggttggtacatatcctgtagtatctgtattccttgcacatccttctgtcctgtagactgggggctcactgagtgcagtgacacttttcatcatgggtccccgggttctcacgtggagtctgacacatgaatacatggctatcatgtctgtcaccttcaatggggcaaacaaactttgtaatggtaggaaacacaacaggtacaataatttacaaaaatatgtttgccacatttcagggcaaggcaaaatgcagtggagacatatgttaaattcttatcattcacatttgttctttttatctttaggatgaagctcttacaccaagtgtcacgagtctggagaacagatgggttgagtagttgt

SEQ ID NO: 291775 - DNA, 4515 bp, Homo sapiens
cttaagtatctgtttagaagtttaggaattttctatactgtcttcttgaaatcaacttagagaaaatgaacacaatagattttaagatcttaattcactaatgtttaatgaatatgtttgatgctgacacaaccaccaacttggtaacaatttctttcattttgcctataggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgatgtacttcaattccacattaacggattcctctaagcttctgaaacctctcttggtcttcacatttatcatctgtggaataatctgcgggctaacacggataactcagtataagaaccacccagttgatgtctattgtggctttttaataggaggaggaattgcactgtacttgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctactcgcaaaagaccatatgttgattctacctgtgttctgttccagcgaattgggaagtctcaccaagctagattgtctaccatcagcccagaactctgtaacttttcagaactgctatactcaaacttgcagatctcacatcaaggagagggaaaagcacaatgcaagaacctaactaacgtgatgatatgaagagttttcttaagacctgtcgtcaaacttaaaaggttttgcagagggcagtatcaaaagaaagtggttttcttcaaatgtatactattttacttcctgaatgtgccaactttggggatttttctttatagtgagctgtgggaacccagaacacacacgttttccctacagcagaggccatgcagtattatatattcattttgcagaatctgcacctacagctcaatacgggtggtgctgattattatagtacatataccatgtaaactctcaaactctatttagctgtgaaatagtggtgtgcaattccttgttaaagaaatgctactttattaagaagatgctggctgctttgtgttagaataggacaccccgcagcttctctgtagtggctctgtcacagtcaaaaaatgaaaaggtttttgtgcgtttcttcaaaattctgctttcttcaacatcaaaaattgtgtagaaatattttcagtgaaagggaataactagtacttttctgcatagtttttcttctgcttactttttatttaagtataggtactgctaatgaatctgttttcttagtgagtaaatttgcataattttataaatattattttagagaatcttttgaaattgttgtgatcatattttgctttctatggcttctccttaacttattgattaattttttgaagttatagatatgttctcctattttaaaagcaaaaataacaattgacattccttgagcaaaatatactgctgtgaatttgcaaacaagaaatctgagccaaaacttgacattgtgggttacattgccagaaatgttggtcaagtttgcccttagatgtctacaactagctggcataggttgccatcttaacaagtaatctaaaagtcccattcggttctacattattaactttttttttctatatcctgatgaccagtaaattagagccacactggttaagtttgactcgtctctaaaacgtttttgttaattggacaccaagaggaagaatctgaaaaaaaaatgcatgttggtaagtaaaagtatctcacggtacaaattaagaatgactttcttcaaaatatctgaataggtgcagttttagtttaacatgcaaacaaccattgttgctacctatcctgaatcaagccttgagcctaaatcaaagcaaaccaataccattgataagaagaagataaaaacaaaatattttggagtgttttccaacttaaagtatgaagacatactcagttcttggaacttagtattaaaccttttttatgccatttcataagaattccgatatatacttgatgattgccaaggggatgaaaggaaacaacagagatggttgatctgatcttagctcactttccaataacagaaggagttgtttacagatgaatagtatcacatcattatcaatttccacatgaaaaaggtggagctttctagaaaaaccaacctctaaggcattaggaatttagctgaaaccagcagaattgaaaactctggcaataaaacatggactcaaccatatcccttctggcaatttccttctcagagaggggagtgggaataaaatgttgccttccccacttctcaccaccaccgccatcatgacgctcatactggcttttgcctgtttgtagaggaaaaggtgggctggttttagtactctgaaggacaaaaacaagcaaacaaaaacccctgctgcagcatttcaggtgcagtatgatatttcctaatctttcctatttcttaacaaaagattttaaagtacttctctagtcattgaagtttttttttctttacataaatattgatatattctttttctactcaaagtgccaaaggctacagtttttaatgacttaacaaattgtaccacattgttaaggacatataatgatagacactagaactcagacctctgcatgtatatttgataacatgtcttttgtaaaacaaaaattacaaaaaaatttgtttacattccactggtaccttaatttaaaataaatcagactaaaaggtggtatctcttcttagtgttctatttatcttatttgctaatgggagcacttcttcctttgttaggctgtgctttactgataaaaccaagtattgaataaagagagttaattatctttttaaagtaaataaaattatgaaaatatatatagtatatataaagtactgtgtttaaaaaaatgttatgcaatgttttccaaactgataaagtttgtaaagtgctataaatgtattttgttaagtacagataaaagctattgtgtgagtatattgtgctaaaatcatagaaataaagattagatttcttcatcaaaattggaatagtttggtt

SEQ ID NO: 291776 - DNA, 4858 bp, Homo sapiens
ggccgcggggaatgtgacatcagcggcgccgggcgcttggggctggaggaggcagctcgcctcagctgcgctgtgcacacctcgcccgggggaggacgcagacccgggcaggcggcagggatgtcggcgaaggagaggccaaagggcaaagtgatcaaggacagcgtcaccctcctgccctgcttttatttcgtcgagttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgatgtacttcaattccacattaacggattcctctaagcttctgaaacctctcttggtcttcacatttatcatctgtggaataatctgcgggctaacacggataactcagtataagaaccacccagttgatgtctattgtggctttttaataggaggaggaattgcactgtacttgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctactcgcaaaagaccatatgttgattctacctgtgttctgttccagcgaattgggaagtctcaccaagctagattgtctaccatcagcccagaactctgtaacttttcagaactgctatactcaaacttgcagatctcacatcaaggagagggaaaagcacaatgcaagaacctaactaacgtgatgatatgaagagttttcttaagacctgtcgtcaaacttaaaaggttttgcagagggcagtatcaaaagaaagtggttttcttcaaatgtatactattttacttcctgaatgtgccaactttggggatttttctttatagtgagctgtgggaacccagaacacacacgttttccctacagcagaggccatgcagtattatatattcattttgcagaatctgcacctacagctcaatacgggtggtgctgattattatagtacatataccatgtaaactctcaaactctatttagctgtgaaatagtggtgtgcaattccttgttaaagaaatgctactttattaagaagatgctggctgctttgtgttagaataggacaccccgcagcttctctgtagtggctctgtcacagtcaaaaaatgaaaaggtttttgtgcgtttcttcaaaattctgctttcttcaacatcaaaaattgtgtagaaatattttcagtgaaagggaataactagtacttttctgcatagtttttcttctgcttactttttatttaagtataggtactgctaatgaatctgttttcttagtgagtaaatttgcataattttataaatattattttagagaatcttttgaaattgttgtgatcatattttgctttctatggcttctccttaacttattgattaattttttgaagttatagatatgttctcctattttaaaagcaaaaataacaattgacattccttgagcaaaatatactgctgtgaatttgcaaacaagaaatctgagccaaaacttgacattgtgggttacattgccagaaatgttggtcaagtttgcccttagatgtctacaactagctggcataggttgccatcttaacaagtaatctaaaagtcccattcggttctacattattaactttttttttctatatcctgatgaccagtaaattagagccacactggttaagtttgactcgtctctaaaacgtttttgttaattggacaccaagaggaagaatctgaaaaaaaaatgcatgttggtaagtaaaagtatctcacggtacaaattaagaatgactttcttcaaaatatctgaataggtgcagttttagtttaacatgcaaacaaccattgttgctacctatcctgaatcaagccttgagcctaaatcaaagcaaaccaataccattgataagaagaagataaaaacaaaatattttggagtgttttccaacttaaagtatgaagacatactcagttcttggaacttagtattaaaccttttttatgccatttcataagaattccgatatatacttgatgattgccaaggggatgaaaggaaacaacagagatggttgatctgatcttagctcactttccaataacagaaggagttgtttacagatgaatagtatcacatcattatcaatttccacatgaaaaaggtggagctttctagaaaaaccaacctctaaggcattaggaatttagctgaaaccagcagaattgaaaactctggcaataaaacatggactcaaccatatcccttctggcaatttccttctcagagaggggagtgggaataaaatgttgccttccccacttctcaccaccaccgccatcatgacgctcatactggcttttgcctgtttgtagaggaaaaggtgggctggttttagtactctgaaggacaaaaacaagcaaacaaaaacccctgctgcagcatttcaggtgcagtatgatatttcctaatctttcctatttcttaacaaaagattttaaagtacttctctagtcattgaagtttttttttctttacataaatattgatatattctttttctactcaaagtgccaaaggctacagtttttaatgacttaacaaattgtaccacattgttaaggacatataatgatagacactagaactcagacctctgcatgtatatttgataacatgtcttttgtaaaacaaaaattacaaaaaaatttgtttacattccactggtaccttaatttaaaataaatcagactaaaaggtggtatctcttcttagtgttctatttatcttatttgctaatgggagcacttcttcctttgttaggctgtgctttactgataaaaccaagtattgaataaagagagttaattatctttttaaagtaaataaaattatgaaaatatatatagtatatataaagtactgtgtttaaaaaaatgttatgcaatgttttccaaactgataaagtttgtaaagtgctataaatgtattttgttaagtacagataaaagctattgtgtgagtatattgtgctaaaatcatagaaataaagattagatttcttcatcaaaattggaatagtttggtt

SEQ ID NO: 291777 - DNA, 465 bp, Homo sapiens
gatgttgcagttcagctctgaggcagtttggaagcagaattcttcctccagtgatctcagtcttttttctcttaagaatttcaactgattggatgaggcctacccacattatggagggtaatctgctttactctctactgacttaaatattaatccatctaaaaaataggccaggcatggtggctcatgcctataattccaccactattgggaggctgaggcacctcacggcaacctctgaagaaggaattatagaaccaactttttattgttgaaaatggagtcttgtagagttcagtgatgggaaactaaagtagaaaaagcacatcacaaagaaacatatatagtacagtgtgatcccaattttgtaaaaatatctgtaatatgtaagcataggtatttgtatatcttaagaaaaaaagcctagaaataaagccacaaaaatattaaaaaaaaatatttgac

SEQ ID NO: 291778 - DNA, 2375 bp, Homo sapiens
gatgttgcagttcagctctgaggcagtttggaagcagaattcttcctccagtgatctcagtcttttttctcttaagaatttcaactgattggatgaggcctacccacattatggagggtaatctgctttactctctactgacttaaatattaatccatctaaaaaataggccaggcatggtggctcatgcctataattccaccactattgggaggctgaggcaggaggatcacttgagcccaggagttcaagaccagcctgggcaatgtagagacccccatctctagggggagaaaaaaaagccaggtatggtagtgcacacctatagtcccagctactcagaaggctgaggtgggaggatcgcttgaacctgggaggttgaggctgcagtcagccatggtcatgccactgtactccagcctgggtgacaagagggagaccctgtcttgaaaaaaagaaaccatcatcacagcaacatctagactagtgtttgactaaaaactggataccatggcctagccaaattgacacacaaaatagaccatcacagtcccaaggcctaaaatacttactatctgagcctttacaaaacaggattgccagccactgaagagaacaaatggtcccaccccctgctgagctcacagtctggctctcctgtgtgcagccacttcttggagctggcttctctccactccccctccagatgctggtcagccaggcggttataaagaatctcatctgctgaaggcttttagcagggactgagtcctgtagctgttggacacctcctgtgggttgggtcactcagaccattcagaatccactgagctgagcttttgcatcttggattgagatctggatgagccaggaggcaggagaggctaggtggtcctcatgaccctaggatagctcttgctgagggatggtggcattctgccctacctctggctcccaggtgccgactggactttgtgagctccagctgctacagttgactgagttcaggctccatgtagctgggatatactacatggttacccctcacccctatggagcttccaaaagagaccctccctcaaagcacagccccttctctgagtgcaaataatggccatcagaggtcagtcacaggtgttaggcaggcatctatgaagctggggatgatagcactgacttcagtgcttggacgagaaccaggagagagtgtgtagaaaaagcacagccagcctcccataaaaggacagactcctgtgacaaccttgtcactctgttcctccctgatactctgggggaggtggaggccagtgggcagttctgaaagctcagcaggtttggagccattgggtgtggactcctctcccagtgttcctcctgggtgttcacagatgttattgaatgcacactggaaccctgcacaggtaaactgaggctttattggcgtgactgccaaaggtcacacagggtggtttggcagagctgggattagaagcccagcctgtctctcttcagtagtaatggagtcctgggaggtttactaggctttagcctcaatctgtggcggcagggtccacagccctggggagtgacacagtcatggtccccatgattggccaggacctgtgtggagagacacaggagacaagaccctgctcttccaggccagaagggaggggagccccagagctgggcagtggcatgccccacagcctggccacctgcttcggctacgcaccatgcagcagctgcacctggctgcctcgggaaaactctgacctctctgggaagtggagccagtggctctgtgggcgtcctttcctgcagcctggagagcaaagcggctttccctgggactgtgtggctcctgtcccaactggcctccccattccacattcccattgctggaccagcaccaggactgggcacagggcttccttttgctgattcatttcccccctaactcattcagagttgagccccatctgagtccccacatgctggccctgaaacggttacaaaggctgaaaccagggatggcaggcccaggatcagtgctgtggctgttggagtgtcctctccaacagcatgacagccgcctccaggtgctcccagcatctgttgcagtcatggcagcctcacggcaacctctgaagaaggaattatagaaccaactttttattgttgaaaatggagtcttgtagagttcagtgatgggaaactaaagtagaaaaagcacatcacaaagaaacatatatagtacagtgtgatcccaattttgtaaaaatatctgtaatatgtaagcataggtatttgtatatcttaagaaaaaaagcctagaaataaagccacaaaaatattaaaaaaaaatatttgac

SEQ ID NO: 291779 - DNA, 1319 bp, Homo sapiens
gatgttgcagttcagctctgaggcagtttggaagcagaattcttcctccagtgatctcagtcttttttctcttaagaatttcaactgattggatgaggcctacccacattatggagggtaatctgctttactctctactgacttaaatattaatccatctaaaaaataggccaggcatggtggctcatgcctataattccaccactattgggaggctgaggcaggaggatcacttgagcccaggagttcaagaccagcctgggcaatgtagagacccccatctctagggggagaaaaaaaagccaggtatggtagtgcacacctatagtcccagctactcagaaggctgaggtgggaggatcgcttgaacctgggaggttgaggctgcagtcagccatggtcatgccactgtactccagcctgggtgacaagagggagaccctgtcttgaaaaaaagaaaccatcatcacagcaacatctagactagtgtttgactaaaaactggataccatggcctagccaaattgacacacaaaatagaccatcacagtcccaaggcctaaaatacttactatctgagcctttacaaaacaggattgccagccactgaagagaacaaatggtcccaccccctgctgagctcacagtctggctctcctgtgtgcagccacttcttggagctggcttctctccactccccctccagatgctggtcagccaggcggttataaagaatctcatctgctgaaggcttttagcagggactgagtcctgtagctgttggacacctcctgtgggttgggtcactcagaccattcagaatccactgagctgagcttttgcatcttggattgagatctggatgagccaggaggcaggagaggctaggtggtcctcatgaccctaggatagctcttgctgagggatggtggcattctgccctacctctggctcccaggtgccgactggactttgtgagctccagctgctacagttgactgagttcaggctccatgtagctgggatatactacatggttacccctcacccctatggagcttccaaaagagaccctccctcaaagcacagccccttctctgagtgcaaataatggccatcagaggtcagtcacaggtgttaggcaggcatctggagggggagtggagagaagccagctccaagaagtggctgcacacaggagagccagactgtgagctcagcagggggtgggaccatttgttctcttcagtggctggcaatcctgtttagtaaaggctcagatagcaactatccagagggcctttgcgcctgtgatggta

SEQ ID NO: 291780 - DNA, 488 bp, Homo sapiens
acccgaggtccctgtacctacttttcccatctgacagtcaggttttaccttccaggtgacaaggtcagtcgatcaccaagagcttcctcatttcctgatcctgggataggtagttgggatacaggaagtagatacaagtagaacacaaaagatgaccctttgactggagaagtttatgatctagttaataaagcaagaccaggccaggtgcggtggctcacgcctgtaatcccagcactttgggaggctgaggcgggtggatcacaaggtcaggagttcaagaccagcaggctggccaacatagtgaaacctcatctctactaaaaatacaaaaaattagccaggtgtggtggcaggcgcctgtagtcccagctacttggggagaatgaggcaggagaatcacttgaacctgggaggcagagattgcagtgagccgagatcacaccactgcactccgtcctgggcaacaagagtgaaactccatctcc

SEQ ID NO: 291781 - DNA, 3515 bp, Homo sapiens
agcggagcgccaggcagcgcggagcggaggtcgggcccacagccgctccgcctcccggcccgcagatccccgacggccgcaccgcgggctcctctggcccgcaagaacacgtgcatggcgtcctggggaaggcgctgagtgcggagtcgcggcgccgcacgcggcaccatggccctggagcaggcgctgcaggcggcgcggcagggcgagctggacgtgctgaggtcgctgcacgccgcaggcctcctggggccctcgctgcgcgacccgctggacgcgctgcccgtgcaccacgcggcccgcgctgggaagctgcactgtctgcgcttcctggtggaggaagccgccctccccgccgcggcccgcgcccgcaacggcgccacaccggcccacgacgcctccgccaccggccacctcgcctgcctgcagtggctgctgtcgcagggcggctgcagagtgcaggacaaagacaattctggtgccacagtcttgcatctggctgcccgcttcggccaccccgaggtggtgaactggctcttgcatcatggcggtggggaccccaccgcggccacagacatgggcgccctgcctatccactacgctgccgccaaaggagacttcccctccctgaggcttctcgtcgagcactaccctgagggagtgaatgcccaaaccaagaacggtgccacgcccctgtacctggcgtgccaggagggccacctggaggtgacccagtacctggtgcaggaatgcggcgcagacccgcacgcgcgcgcccacgacggcatgaccccgctgcacgccgcggcgcagatgggccacagcccagtcatcgtgtggttggtgagctgcaccgacgtgagcctgtccgagcaggacaaagacggcgccaccgccatgcacttcgcggcgagccgcggccacaccaaggtgctcagctggctgctgctgcacggcggggagatctcggctgacctgtggggcgggaccccgctgcacgacgccgccgagaacggggagctagagtgctgccagatcctggtagtgaacggcgcggagctggacgtccgcgaccgggacgggtacacggccgccgacctgtcggacttcaacggccacagccactgcacccgctacctgcgcacggtggagaacctgagcgtggagcaccgcgtgctttcccgggatccatccgcagagctggaggctaagcagccggattcaggcatgtcctcacccaataccacggtgtcggtccagccgctgaactttgacctcagctcgcctaccagcaccctctccaactacgactcctgctcctccagccactccagcatcaagggccagcaccctccatgtgggctttccagcgctagagctgcagacatacagagctacatggacatgctgaacccggagctgggcctgcctcggggcacgattgggaagcccacacccccaccacccccacccagcttccccccgccacccccgcccccaggcacccaactgcccccacccccacctggctacccagctcccaagcctcctgtaggaccacaggcagctgacatctacatgcagaccaagaacaaactccgccacgtggagacagaggccctcaagaaggagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggtgcgtgcccgccagcccgcgcgcgccggctgcccgcgcctcggccctgccgcccgcggctcactcgaaggcccctccgctcccccgcaggcggcgctgcttcctgggaaccatgttcctaacggctgcgccgcggaccccaaggcgtccagggagctgccactgccgcccccaccgccgccgccgcccctgccggaggccgcgagttcgccaccgccggccccgcctctgcccctcgagagcgctggccctggctgcgggcagcgccgctcctcctcgtccaccggcagcaccaagtctttcaacatgatgtccccgacgggcgacaactcggagctactggctgagattaaggcaggcaagagcctgaagccgacgccccagagcaaggggctgaccacagtgttctcaggcatcgggcagccggccttccagcccgattcgccgctgccttctgtgtcacctgcactgtcaccagtccggagccccacaccgccagctgcggggtttcagccgctgctcaatggaagcttggttcccgtgccgcccactactcctgcgccgggagtgcagctggacgtggaggctctcatccccacgcacgatgagcagggccggcccatccccgagtggaagcgccaggtgatggtgcgcaagatgcagctgaagatgcaggaggaggaggagcagaggcggaaggaggaggaggaggaggcccggctggccagcatgcccgcctggaggcgggacctcctgcggaagaagctggaagaagagagggagcagaagcggaaagaggaggagcgacagaagcaggaggagctgcggcgggagaaggaacagtcagagaagctgcggacgctgggctacgatgagagcaagctggcgccctggcagcgacaggtcatcctgaagaagggggacatcgctaagtactagaggccgcagactcctgtccgcagcctcgcagctccgtggggccctccgccccagccccagccagccaggccctggtggaaaggctgggagccgcacagccctcccctcctgcgctggaaaccctccctgacccccaccctggccccccgtatccccagcccttggcaacactggagtgcacacgccgccacggttgcccagaaaaagtgcccaagctgctgacgcaaacaacaacaaatgctgcttatttgcatgccgacttacatatatttgcatgttcgttgactatcaaagagtgcagagctctccccagccccgtgggtggtgactttgttttcctgcggggctcagcccctccaggatgcagccccctcccccgcaccccggaaccggcgtcgctggcgcatcctgggtggaggcaggccccgagctcggggaaggggttttcccttcctctctgacccagatctgcgcgcggcctagcccgggcctcatttcttatccccgccaagggtttcctctcagtcatttgtttaccagaaacatgaaaactgcctgtctggccgggccgcacttgtggcccccgggaccccacctctggccccacctccctcaagtctgcgccccgtccccagccagacccactcgctgccgggaccctttcactgccccggtggagtgaatagaggatgaggggccctgaccctgtgtctccaactgctgcaccccatcccgaccctgtctccgccacctcgcagccccattaaagcgctctcatctgg

SEQ ID NO: 291782 - DNA, 3945 bp, Homo sapiens
agcggagcgccaggcagcgcggagcggaggtcgggcccacagccgctccgcctcccggcccgcagatccccgacggccgcaccgcgggctcctctggcccgcaagaacacgtgcatggcgtcctggggaaggcgctgagtgcggagtcgcggcgccgcacgcggcaccatggccctggagcaggcgctgcaggcggcgcggcagggcgagctggacgtgctgaggtcgctgcacgccgcaggcctcctggggccctcgctgcgcgacccgctggacgcgctgcccgtgcaccacgcggcccgcgctgggaagctgcactgtctgcgcttcctggtggaggaagccgccctccccgccgcggcccgcgcccgcaacggcgccacaccggcccacgacgcctccgccaccggccacctcgcctgcctgcagtggctgctgtcgcagggcggctgcagagtgcaggacaaagacaattctggtgccacagtcttgcatctggctgcccgcttcggccaccccgaggtggtgaactggctcttgcatcatggcggtggggaccccaccgcggccacagacatgggcgccctgcctatccactacgctgccgccaaaggagacttcccctccctgaggcttctcgtcgagcactaccctgagggagtgaatgcccaaaccaagaacggtgccacgcccctgtacctggcgtgccaggagggccacctggaggtgacccagtacctggtgcaggaatgcggcgcagacccgcacgcgcgcgcccacgacggcatgaccccgctgcacgccgcggcgcagatgggccacagcccagtcatcgtgtggttggtgagctgcaccgacgtgagcctgtccgagcaggacaaagacggcgccaccgccatgcacttcgcggcgagccgcggccacaccaaggtgctcagctggctgctgctgcacggcggggagatctcggctgacctgtggggcgggaccccgctgcacgacgccgccgagaacggggagctagagtgctgccagatcctggtagtgaacggcgcggagctggacgtccgcgaccgggacgggtacacggccgccgacctgtcggacttcaacggccacagccactgcacccgctacctgcgcacggtggagaacctgagcgtggagcaccgcgtgctttcccgggatccatccgcagagctggaggctaagcagccggattcaggcatgtcctcacccaataccacggtgtcggtccagccgctgaactttgacctcagctcgcctaccagcaccctctccaactacgactcctgctcctccagccactccagcatcaagggccagcaccctccatgtgggctttccagcgctagagctgcagacatacagagctacatggacatgctgaacccggagctgggcctgcctcggggcacgattgggaagcccacacccccaccacccccacccagcttccccccgccacccccgcccccaggcacccaactgcccccacccccacctggctacccagctcccaagcctcctgtaggaccacaggcagctgacatctacatgcagaccaagaacaaactccgccacgtggagacagaggccctcaagaaggagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggtgcgtgcccgccagcccgcgcgcgccggctgcccgcgcctcggccctgccgcccgcggctcactcgaaggcccctccgctcccccgcaggcggcgctgcttcctgggaaccatgttcctaacggctgcgccgcggaccccaaggcgtccagggagctgccactgccgcccccaccgccgccgccgcccctgccggaggccgcgagttcgccaccgccggccccgcctctgcccctcgagagcgctggccctggctgcgggcagcgccgctcctcctcgtccaccggcagcaccaagtctttcaacatgatgtccccgacgggcgacaactcggagctactggctgagattaaggcaggcaagagcctgaagccgacgccccagagcaaggggctgaccacagtgttctcaggcatcgggcagccggccttccagcccgattcgccgctgccttctgtgtcacctgcactgtcaccagtccggagccccacaccgccagctgcggggtttcagccgctgctcaatggaagcttggttcccgtgccgcccactactcctgcgccgggagtgcagctggacgtggaggctctcatccccacgcacgatgagcagggccggcccatccccgagtggaagcgccaggtgatggtgcgcaagatgcagctgaagatgcaggaggaggaggagcagaggcggaaggaggaggaggaggaggcccggctggccagcatgcccgcctggaggcgggacctcctgcggaagaagctggaagaagagagggagcagaagcggaaagaggaggagcgacagaagcaggaggagctgcggcgggagaaggaacagtcagagaagctgcggacgctgggctacgatgagagcaagctggcgccctggcagcgacaggtcatcctgaagaagggggacatcgctaagtactagaggccgcagactcctgtccgcagcctcgcagctccgtggggccctccgccccagccccagccagccaggccctggtggaaaggctgggagccgcacagccctcccctcctgcgctggaaaccctccctgacccccaccctggccccccgtatccccagcccttggcaacactggagtgcacacgccgccacggttgcccagaaaaagtgcccaagctgctgacgcaaacaacaacaaatgctgcttatttgcatgccgacttacatatatttgcatgttcgttgactatcaaagagtgcagagctctccccagccccgtgggtggtgactttgttttcctgcggggctcagcccctccaggatgcagccccctcccccgcaccccggaaccggcgtcgctggcgcatcctgggtggaggcaggccccgagctcggggaaggggttttcccttcctctctgacccagatctgcgcgcggcctagcccgggcctcatttcttatccccgccaagggtttcctctcagtcatttgtttaccagaaacatgaaaactgcctgtctggccgggccgcacttgtggcccccgggaccccacctctggccccacctccctcaagtctgcgccccgtccccagccagacccactcgctgccgggaccctttcactgccccggtggagtgaatagaggatgaggggccctgaccctgtgtctccaactgctgcaccccatcccgaccctgtctccgccacctcgcagccccattaaagcgctctcatctgggctccggttcactcactcgctgtggccgcgacttgctctctccttctcgggatttaataccgcgatctcagccaaactccggccgagaagttgagaaatgtcttcaccccctctcgacattcgttcgtgcttcttcgccttggctggagcgataggggcgagcaggggtggggccggctggtgctgctacgcagggccgtgccagcggcttaataagtgacataaaatgtctacacgcataaagtaaccgtacttagggcttctgcaagggccaccagagcgcctaggtggcaagtgggcgccgtgtcacgggccgcgctgcaggcggctgcgcaagtcttccacgcagccgtccagccccatgcgctccagggccgcgtaaacggctccgaggcccgcgggctgctgctggcgccagcgcttgagcatc

SEQ ID NO: 291783 - DNA, 2119 bp, Homo sapiens
catgaccctcgcccgctgcccactgtgagaaccagggggtctaggaagtcagctgctgcacccctcgacggccgctggccgcgagtccccaggagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggcaccaagtctttcaacatgatgtccccgacgggcgacaactcggagctactggctgagattaaggcaggcaagagcctgaagccgacgccccagagcaaggggctgaccacagtgttctcaggcatcgggcagccggccttccagcccgattcgccgctgccttctgtgtcacctgcactgtcaccagtccggagccccacaccgccagctgcggggtttcagccgctgctcaatggaagcttggttcccgtgccgcccactactcctgcgccgggagtgcagctggacgtggaggctctcatccccacgcacgatgagcagggccggcccatccccgagtggaagcgccaggtgatggtgcgcaagatgcagctgaagatgcaggaggaggaggagcagaggcggaaggaggaggaggaggaggcccggctggccagcatgcccgcctggaggcgggacctcctgcggaagaagctggaagaagagagggagcagaagcggaaagaggaggagcgacagaagcaggaggagctgcggcgggagaaggaacagtcagagaagctgcggacgctgggctacgatgagagcaagctggcgccctggcagcgacaggtcatcctgaagaagggggacatcgctaagtactagaggccgcagactcctgtccgcagcctcgcagctccgtggggccctccgccccagccccagccagccaggccctggtggaaaggctgggagccgcacagccctcccctcctgcgctggaaaccctccctgacccccaccctggccccccgtatccccagcccttggcaacactggagtgcacacgccgccacggttgcccagaaaaagtgcccaagctgctgacgcaaacaacaacaaatgctgcttatttgcatgccgacttacatatatttgcatgttcgttgactatcaaagagtgcagagctctccccagccccgtgggtggtgactttgttttcctgcggggctcagcccctccaggatgcagccccctcccccgcaccccggaaccggcgtcgctggcgcatcctgggtggaggcaggccccgagctcggggaaggggttttcccttcctctctgacccagatctgcgcgcggcctagcccgggcctcatttcttatccccgccaagggtttcctctcagtcatttgtttaccagaaacatgaaaactgcctgtctggccgggccgcacttgtggcccccgggaccccacctctggccccacctccctcaagtctgcgccccgtccccagccagacccactcgctgccgggaccctttcactgccccggtggagtgaatagaggatgaggggccctgaccctgtgtctccaactgctgcaccccatcccgaccctgtctccgccacctcgcagccccattaaagcgctctcatctgggctccggttcactcactcgctgtggccgcgacttgctctctccttctcgggatttaataccgcgatctcagccaaactccggccgagaagttgagaaatgtcttcaccccctctcgacattcgttcgtgcttcttcgccttggctggagcgataggggcgagcaggggtggggccggctggtgctgctacgcagggccgtgccagcggcttaataagtgacataaaatgtctacacgcataaagtaaccgtacttagggcttctgcaagggccaccagagcgcctaggtggcaagtgggcgccgtgtcacgggccgcgctgcaggcggctgcgcaagtcttccacgcagccgtccagccccatgcgctccagggccgcgtaaacggctccgaggcccgcgggctgctgctggcgccagcgcttgagcatc

SEQ ID NO: 291784 - DNA, 1959 bp, Homo sapiens
gctgtcccagtctcatcctgccccccctccctcctaactccgctgtcacttctctcctcttggtccctagaagtgagagtcctgaggcacaggaagagcaccaagtctttcaacatgatgtccccgacgggcgacaactcggagctactggctgagattaaggcaggcaagagcctgaagccgacgccccagagcaaggggctgaccacagtgttctcaggcatcgggcagccggccttccagcccgattcgccgctgccttctgtgtcacctgcactgtcaccagtccggagccccacaccgccagctgcggggtttcagccgctgctcaatggaagcttggttcccgtgccgcccactactcctgcgccgggagtgcagctggacgtggaggctctcatccccacgcacgatgagcagggccggcccatccccgagtggaagcgccaggtgatggtgcgcaagatgcagctgaagatgcaggaggaggaggagcagaggcggaaggaggaggaggaggaggcccggctggccagcatgcccgcctggaggcgggacctcctgcggaagaagctggaagaagagagggagcagaagcggaaagaggaggagcgacagaagcaggaggagctgcggcgggagaaggaacagtcagagaagctgcggacgctgggctacgatgagagcaagctggcgccctggcagcgacaggtcatcctgaagaagggggacatcgctaagtactagaggccgcagactcctgtccgcagcctcgcagctccgtggggccctccgccccagccccagccagccaggccctggtggaaaggctgggagccgcacagccctcccctcctgcgctggaaaccctccctgacccccaccctggccccccgtatccccagcccttggcaacactggagtgcacacgccgccacggttgcccagaaaaagtgcccaagctgctgacgcaaacaacaacaaatgctgcttatttgcatgccgacttacatatatttgcatgttcgttgactatcaaagagtgcagagctctccccagccccgtgggtggtgactttgttttcctgcggggctcagcccctccaggatgcagccccctcccccgcaccccggaaccggcgtcgctggcgcatcctgggtggaggcaggccccgagctcggggaaggggttttcccttcctctctgacccagatctgcgcgcggcctagcccgggcctcatttcttatccccgccaagggtttcctctcagtcatttgtttaccagaaacatgaaaactgcctgtctggccgggccgcacttgtggcccccgggaccccacctctggccccacctccctcaagtctgcgccccgtccccagccagacccactcgctgccgggaccctttcactgccccggtggagtgaatagaggatgaggggccctgaccctgtgtctccaactgctgcaccccatcccgaccctgtctccgccacctcgcagccccattaaagcgctctcatctgggctccggttcactcactcgctgtggccgcgacttgctctctccttctcgggatttaataccgcgatctcagccaaactccggccgagaagttgagaaatgtcttcaccccctctcgacattcgttcgtgcttcttcgccttggctggagcgataggggcgagcaggggtggggccggctggtgctgctacgcagggccgtgccagcggcttaataagtgacataaaatgtctacacgcataaagtaaccgtacttagggcttctgcaagggccaccagagcgcctaggtggcaagtgggcgccgtgtcacgggccgcgctgcaggcggctgcgcaagtcttccacgcagccgtccagccccatgcgctccagggccgcgtaaacggctccgaggcccgcgggctgctgctggcgccagcgcttgagcatc

SEQ ID NO: 291785 - DNA, 3853 bp, Homo sapiens
agcggagcgccaggcagcgcggagcggaggtcgggcccacagccgctccgcctcccggcccgcagatccccgacggccgcaccgcgggctcctctggcccgcaagaacacgtgcatggcgtcctggggaaggcgctgagtgcggagtcgcggcgccgcacgcggcaccatggccctggagcaggcgctgcaggcggcgcggcagggcgagctggacgtgctgaggtcgctgcacgccgcaggcctcctggggccctcgctgcgcgacccgctggacgcgctgcccgtgcaccacgcggcccgcgctgggaagctgcactgtctgcgcttcctggtggaggaagccgccctccccgccgcggcccgcgcccgcaacggcgccacaccggcccacgacgcctccgccaccggccacctcgcctgcctgcagtggctgctgtcgcagggcggctgcagagtgcaggacaaagacaattctggtgccacagtcttgcatctggctgcccgcttcggccaccccgaggtggtgaactggctcttgcatcatggcggtggggaccccaccgcggccacagacatgggcgccctgcctatccactacgctgccgccaaaggagacttcccctccctgaggcttctcgtcgagcactaccctgagggagtgaatgcccaaaccaagaacggtgccacgcccctgtacctggcgtgccaggagggccacctggaggtgacccagtacctggtgcaggaatgcggcgcagacccgcacgcgcgcgcccacgacggcatgaccccgctgcacgccgcggcgcagatgggccacagcccagtcatcgtgtggttggtgagctgcaccgacgtgagcctgtccgagcaggacaaagacggcgccaccgccatgcacttcgcggcgagccgcggccacaccaaggtgctcagctggctgctgctgcacggcggggagatctcggctgacctgtggggcgggaccccgctgcacgacgccgccgagaacggggagctagagtgctgccagatcctggtagtgaacggcgcggagctggacgtccgcgaccgggacgggtacacggccgccgacctgtcggacttcaacggccacagccactgcacccgctacctgcgcacggtggagaacctgagcgtggagcaccgcgtgctttcccgggatccatccgcagagctggaggctaagcagccggattcaggcatgtcctcacccaataccacggtgtcggtccagccgctgaactttgacctcagctcgcctaccagcaccctctccaactacgactcctgctcctccagccactccagcatcaagggccagcaccctccatgtgggctttccagcgctagagctgcagacatacagagctacatggacatgctgaacccggagctgggcctgcctcggggcacgattgggaagcccacacccccaccacccccacccagcttccccccgccacccccgcccccaggcacccaactgcccccacccccacctggctacccagctcccaagcctcctgtaggaccacaggcagctgacatctacatgcagaccaagaacaaactccgccacgtggagacagaggccctcaagaaggagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggtgcgtgcccgccagcccgcgcgcgccggctgcccgcgcctcggccctgccgcccgcggctcactcgaaggcccctccgctcccccgcaggcggcgctgcttcctgggaaccatgttcctaacggctgcgccgcggaccccaaggcgtccagggagctgccactgccgcccccaccgccgccgccgcccctgccggaggccgcgagttcgccaccgccggccccgcctctgcccctcgagagcgctggccctggctgcgggcagcgccgctcctcctcgtccaccggcagcaccaagtctttcaacatgatgtccccgacgggcgacaactcggagctactggctgagattaaggcaggcaagagcctgaagccgacgccccagagcaaggggctgaccacagtgttctcaggcatcgggcagccggccttccagcccgattcgccgctgccttctgtgtcacctgcactgtcaccagtccggagccccacaccgccagctgcggggtttcagccgctgctcaatggaagcttggttcccgtgccgcccactactcctgcgccgggagtgcagctggacgtggaggctctcatccccacgcacgatgagcagggccggcccatccccgagtggaagcgccaggtgatggtgcgcaagatgcagctgaagatgcaggaggaggaggagcagaggcggaaggaaagaggaggagcgacagaagcaggaggagctgcggcgggagaaggaacagtcagagaagctgcggacgctgggctacgatgagagcaagctggcgccctggcagcgacaggtcatcctgaagaagggggacatcgctaagtactagaggccgcagactcctgtccgcagcctcgcagctccgtggggccctccgccccagccccagccagccaggccctggtggaaaggctgggagccgcacagccctcccctcctgcgctggaaaccctccctgacccccaccctggccccccgtatccccagcccttggcaacactggagtgcacacgccgccacggttgcccagaaaaagtgcccaagctgctgacgcaaacaacaacaaatgctgcttatttgcatgccgacttacatatatttgcatgttcgttgactatcaaagagtgcagagctctccccagccccgtgggtggtgactttgttttcctgcggggctcagcccctccaggatgcagccccctcccccgcaccccggaaccggcgtcgctggcgcatcctgggtggaggcaggccccgagctcggggaaggggttttcccttcctctctgacccagatctgcgcgcggcctagcccgggcctcatttcttatccccgccaagggtttcctctcagtcatttgtttaccagaaacatgaaaactgcctgtctggccgggccgcacttgtggcccccgggaccccacctctggccccacctccctcaagtctgcgccccgtccccagccagacccactcgctgccgggaccctttcactgccccggtggagtgaatagaggatgaggggccctgaccctgtgtctccaactgctgcaccccatcccgaccctgtctccgccacctcgcagccccattaaagcgctctcatctgggctccggttcactcactcgctgtggccgcgacttgctctctccttctcgggatttaataccgcgatctcagccaaactccggccgagaagttgagaaatgtcttcaccccctctcgacattcgttcgtgcttcttcgccttggctggagcgataggggcgagcaggggtggggccggctggtgctgctacgcagggccgtgccagcggcttaataagtgacataaaatgtctacacgcataaagtaaccgtacttagggcttctgcaagggccaccagagcgcctaggtggcaagtgggcgccgtgtcacgggccgcgctgcaggcggctgcgcaagtcttccacgcagccgtccagccccatgcgctccagggccgcgtaaacggctccgaggcccgcgggctgctgctggcgccagcgcttgagcatc

SEQ ID NO: 291786 - DNA, 1689 bp, Homo sapiens
cgctctttttttctgtttaatttttttgttttagattttcttgtttttttttgcacaaaacaaaaatttattgggagaaagatggctgatgggaggcaagatctggattcaggaatcctcaattttagctctcgctctgtcaccaaaaccctccgtccctcccagagcctcgaggagtttccccttgtgtaaaccggtatcgcgtcccttccagctctgacatcctgcggttctagaatacccattgattgaaagagctgtggccaaacaggaaggacagagcaagagccgctgacaaaggattctgccaagacagaatcccaaggtcacaggagagaggcttggggcagtgaaagccctctcgggtcttggctttggaagtgtggactgtaccagcagatgggcccttgggaagccaacagggaacaattcaaggctggagagaaaaaggccacctttgacccagcagaaggcagaggcgggagaggagggtgaggatgtacaaggagcatcgcaggcgaggaaacaatggccaggacctaactgtggtgggaactgcctttgtctccacacactcgcaatcaacatgcgtatttgctattctcaaacaactcccttccacccccttaggctgaaaggacaaactcatcagagttgaggagtacctacctgatgaagctgttcatgcttccagcatcaaactggacgtttactgtctgcccaaaagccagtttccaaaaggtttgcttccctctgttcagtggattcttgactacatataggtcatatatttcaaaaaataatgcctagctatttctactttgaaatcatgactaaagccaaaccacaaccacagcaaagataacctaaggatttgtttaccagaaatacctacaaaaaagtttgcaggccgggcgcgatggctcacacttgtaatcccagcactttgagaggccgagatgggcagatcacctgaggtcaggggttcaagaccatcctgcccaacatgatgaaacctggtctctactaaaaatacaaaaattaaccgggtgtggtggcgcatgcctgtaatcccagctactcaggagactgaggcggaattgccagaaccctggagggcagaggttgcagtaagctgagatcgggccactgcactccagcctgggtgacagaatgagactcagtctcccaccctgccaaaaagtttgcaatgtcggcagcaaagtgcaaacagagccggctctgggtgaaagctttagttatgaaaaataagaaaaaaaaaatccctaagcatttcttaacactagttttaaagaaaaccccctctccaaaggtatgtttctccttcaactttcttgactttgccaggctgtcaggatgcaagctacctactcttttctggatggatcgggacaaagtttttaaacaaagactgtgtcctctccacaagcccttcccaccaccaccaccccagccccccgccgccataattacaggggctgtgaaatggctgttgagtgatggtcacacaaccagaaggcagatgaaaaggtcaggctctaagaggggttcagcctcccagtaccagcctgctgtgcccaggggtgggagtgctgggagaactgtcttccccagacaggcagctatgccgcctcccactgcaaaggcaccaaaaggcaacatccgtcc

SEQ ID NO: 291787 - DNA, 1062 bp, Homo sapiens
cgctctttttttctgtttaatttttttgttttagattttcttgtttttttttgcacaaaacaaaaatttattgggagaaagatggctgatgggaggcaagatctggattcaggaatcctcaattttagctctcgctctgtcaccaaaaccctccgtccctcccagagcctcgaggagtttccccttgtgtaaaccggtatcgcgtcccttccagctctgacatcctgcggttctagaatacccattgattgaaagagctgtggccaaacaggaaggacagagcaagagccgctgacaaaggattctgccaagacagaatcccaaggtcacaggagagaggcttggggcagtgaaagccctctcgggtcttggctttggaagtgtggactgtaccagcagatgggcccttgggaagccaacagggaacaattcaaggctggagagaaaaaggccacctttgacccagcagaaggcagaggcgggagaggagggtgaggatgtacaaggagcatcgcaggcgaggaaacaatggccaggacctaactgtggtgggaactgcctttgtctccacacactcgcaatcaacatgcgtatttgctattctcaaacaactcccttccacccccttaggctgaaaggacaaactcatcagagttgaggagtacctacctgatgaagctgttcatgcttccagcatcaaactggacgtttactgtctgcccaaaagccagtttccaaaaggctgtcaggatgcaagctacctactcttttctggatggatcgggacaaagtttttaaacaaagactgtgtcctctccacaagcccttcccaccaccaccaccccagccccccgccgccataattacaggggctgtgaaatggctgttgagtgatggtcacacaaccagaaggcagatgaaaaggtcaggctctaagaggggttcagcctcccagtaccagcctgctgtgcccaggggtgggagtgctgggagaactgtcttccccagacaggcagctatgccgcctcccactgcaaaggcaccaaaaggcaacatccgtcc

SEQ ID NO: 291788 - DNA, 1620 bp, Homo sapiens
cgtcgacgggatggagggttttggtgacagagcgagagctaaaattgaggattcctgaatccagatcttgcctcccatcagccatctttctcccagagcctcgaggagtttccccttgtgtaaaccggtatcgcgtcccttccagctctgacatcctgcggttctagaatacccattgattgaaagagctgtggccaaacaggaaggacagagcaagagccgctgacaaaggattctgccaagacagaatcccaaggtcacaggagagaggcttggggcagtgaaagccctctcgggtcttggctttggaagtgtggactgtaccagcagatgggcccttgggaagccaacagggaacaattcaaggctggagagaaaaaggccacctttgacccagcagaaggcagaggcgggagaggagggtgaggatgtacaaggagcatcgcaggcgaggaaacaatggccaggacctaactgtggtgggaactgcctttgtctccacacactcgcaatcaacatgcgtatttgctattctcaaacaactcccttccacccccttaggctgaaaggacaaactcatcagagttgaggagtacctacctgatgaagctgttcatgcttccagcatcaaactggacgtttactgtctgcccaaaagccagtttccaaaaggtttgcttccctctgttcagtggattcttgactacatataggtcatatatttcaaaaaataatgcctagctatttctactttgaaatcatgactaaagccaaaccacaaccacagcaaagataacctaaggatttgtttaccagaaatacctacaaaaaagtttgcaggccgggcgcgatggctcacacttgtaatcccagcactttgagaggccgagatgggcagatcacctgaggtcaggggttcaagaccatcctgcccaacatgatgaaacctggtctctactaaaaatacaaaaattaaccgggtgtggtggcgcatgcctgtaatcccagctactcaggagactgaggcggaattgccagaaccctggagggcagaggttgcagtaagctgagatcgggccactgcactccagcctgggtgacagaatgagactcagtctcccaccctgccaaaaagtttgcaatgtcggcagcaaagtgcaaacagagccggctctgggtgaaagctttagttatgaaaaataagaaaaaaaaaatccctaagcatttcttaacactagttttaaagaaaaccccctctccaaaggtatgtttctccttcaactttcttgactttgccaggctgtcaggatgcaagctacctactcttttctggatggatcgggacaaagtttttaaacaaagactgtgtcctctccacaagcccttcccaccaccaccaccccagccccccgccgccataattacaggggctgtgaaatggctgttgagtgatggtcacacaaccagaaggcagatgaaaaggtcaggctctaagaggggttcagcctcccagtaccagcctgctgtgcccaggggtgggagtgctgggagaactgtcttccccagacaggcagctatgccgcctcccactgcaaaggcaccaaaaggcaacatccgtcc

SEQ ID NO: 291789 - DNA, 1546 bp, Homo sapiens
cacagagcttcaaaaaaagagcgggacagggacaagcgtatctaagaggctgaacatgaatccacagatcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtacccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgaagatcatggactatgaagaatttgcatactgctgggaaaactttgtgtacaatgaaggtcagcaattcatgccttggtacaaattcgatgaaaattatgcattcctgcaccgcacgctaaaggagattctcagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatgagtttgagtactgctgggacacctttgtgtaccgccagggatgtcccttccagccctgggatggactagaggagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacacta

SEQ ID NO: 291790 - DNA, 1827 bp, Homo sapiens
cacagagcttcaaaaaaagagcgggacagggacaagcgtatctaagaggctgaacatgaatccacagatcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtacccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgaagatcatggactatgaagaatttgcatactgctgggaaaactttgtgtacaatgaaggtcagcaattcatgccttggtacaaattcgatgaaaattatgcattcctgcaccgcacgctaaaggagattctcagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatgagtttgagtactgctgggacacctttgtgtaccgccagggatgtcccttccagccctgggatggactagaggagcacagccaagccctgagtgggaggctgcgggccattctccaggtgagggcttcctccctctgcctggtgccccatcggcctccccctcctccccgctcccctgtgccttgccttcccctctgctcagagcctcctctgggttccctgctccccacagggcgcccagctccgtccctccctttccttctcacagcctccttctctttcccacctcccgcatccctccctcctctcccgtcattgtcactgtccccaggccacctccctgtgccctctttccactctctcacctcctgctccattcaacccccctgctcttccagaatcagggaaactgaaggatgggcctcagtctctaaggaaggcagagacctgggttgagcagcagaataaaagatcttcttccaagaaatgcaaacagaccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacacta

SEQ ID NO: 291791 - DNA, 380 bp, Homo sapiens
  misc_feature (91)..(91): n is a, c, g, or t
  misc_feature (109)..(109): n is a, c, g, or t
gggcccccatgcccccccccacaccccggggagcccagcattcctctgtttgtgttgtacagttcctgttggttttgacagatgtataatncccatggtactaccgttnccattagtgtatcatacagaatcgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacacta

SEQ ID NO: 291792 - DNA, 1190 bp, Homo sapiens
cgctcgtgctgttgctggaaagcgagctcgctgtagaccggccgcgacaccatgtagctgcagctgtactcggggagctgcggcggctccgacctgccgcctggcgctgccatgacctgcgagccagaggacagcgaggagggaggacacgcgggaaggaataaactggactacatggaaatcaagactagaagagagggaggaggagctggagctatcctacctcatcagtgttttgtcttctgttgggatgaactttgttaaaactaatgcatggttaagatgaaaggcagaaggaagggtttgataaaccagaacattctcgcctgattgttagtgttctgaagtaaatacagaagaggctccaaaatacagacctctgtacatcaaccttccgtaatccacctgccttgcatatgcagaccatgacaattctacgagctcctggaaacagaactcagaacgcctccccagagaaccctgatgcaaattctctgaaatggtagtcagcatgtgcgttttcctgagaagtgaatgagtcaacagctttcaacagatcttcaaaggcttacttcacccaatgaagttaagaaccactaaagaagaaacctaaaaggaaaatccaggtcatgaactttgcaatttttattcacatacagagaagaggggaggaatctcttgtgtatgttttacttatgtataccactggttcttaataaagggctttttttgcctccagaggtcaatgcctggagacatttttggttgtcacacctagggagatgctattgggatctagtgagtagagaccagagatgctgctaaacatcctacaatgaagtttgctatcactccaaggttttgcatgcgacttaaactgtacatttattaatcaattgctacatgtactaaaatatgtatctctctccaaaaaaaaaaaaaaaaaaaaaaaacaaaaaaggggggggcggtacaaaaagtatcccccgcggggggggcccaacctgtaacgcgcacccaaggattgtcagtgggcacaaggggttccccccaagaaggggggccgaagaataagcagaggcaagagacggcgattcacaaggtgtgactgcgcaaaaccggccagcgcgaactctggcaaaagagcccctaacatcgggggggggcaacaactgggacaaagacaacta

SEQ ID NO: 291793 - DNA, 707 bp, Homo sapiens
tgctgttgctggaaagcgagctcgctgtagaccggccgcgacaccatgtagctgcagctgtactcggggagctgcggcggctccgacctgccgcctggcgctgccatgacctgcgagccagaggacagcgaggagggaggacacgcggtaagcgaggacgatcggaggggaagagcgaggaacagaaagaacgggatcacctgttagctgcagccaggcccccctgcaccgcgagtctggtccgcgtcctgcagccctcggcgctcgcgacaagcgccccacggcgcgcacggccagcctgcaggggggcacctgagaaccttcgggtctcgtggcctgcacccgctgcccggggttccccaaacttgaagcgagtaagcccctgctctgggggcttcccgagttccacccagtcccctatggcccgcagccagggcgctgtccgcgttctgaaatctcccccaaaccgaggggctggggcaggggccaaaggcgcttgcaaggctggaaggggacactgagattccctccctccccgcacctgacccgggacgcagctccaggtgcgcactggaggagaggtgcagacccccgggccaggcgtggaaccgtcagggcgcgctccgcgggtccccaagaggcggacgctgcaggcacattccagcagctgtcgcagccctctcgggggcagaactttcagcttattg

SEQ ID NO: 291794 - DNA, 3074 bp, Homo sapiens
gaattcgcggccgctcgacgctcagcagagctaccagctgccctgttggcttcgctggtcggatcgtcctcctggccccgccaaacaggcggggggagcggccccgactgtggggccatggcagtagtctcctcgttctccgccgccgctagcctagctgagtcgccggcttctgcgctaggggctcccaccgcctccgcaggctaaggagccgctgccaccaacgagctgtgagggttactatgctccctctttgccgccgtctcctcctcttgcccgcgcaggcacccctctggctgctcagtcctgcctcagtgtcaaaccagaagagaagtaaaattcaacaaaaatttatgtgtggagttccttcttaaaagaagaaaaaagtgattatttagactatggatcggagcaaacggaattcaattgcaggatttcctccacgtgtggagcgtcttgaagagtttgaaggaggtggtggaggagaaggaaatgtgagccaggtgggaagagtttggccatcttcgtatcgagctcttataagtgccttttccagactgacgcgtttggatgatttcacctgtgaaaaaatagggtctggcttcttttctgaagtgttcaaggtacgacaccgagcttctggtcaggtgatggctcttaagatgaacacattgagcagtaaccgggcaaacatgctgaaagaagtacagctcatgaatagactctcccatcccaacatccttaggttcatgggtgtatgtgttcatcaaggacaattgcatgcacttacagagtatatcaactccgggaacctggaacagttgctagacagtaacctgcatttgccttggactgtgagggtaaaactggcctatgacatagcagtgggcctcagctaccttcacttcaaaggcatttttcatcgggacctcacatctaagaactgcctgataaagagggatgagaatggttactctgcagtggtagctgactttggcctggctgagaagatccccgatgtcagcatggggagtgagaagctggccgtggtgggttccccattctggatggcacctgaggttctccgagatgagccctataatgaaaaggcagatgtgttctcttatggtatcatcctctgcgagatcatcgcccgcatccaggccgatccggactatcttccccgcacagagaatttcgggctggactatgatgctttccagcacatggtgggagactgtcccccagattttctgcaacttactttcaactgctgtaacatggatcccaaactgcgcccatcttttgtggagattgggaagaccctggaggaaattctgagccgcctacaggaagaagagcaggagagggataggaagctgcagcccacagccaggggactcttggagaaagcacctggggtgaagcgactaagctcactggatgacaagatcccccacaagtcaccatgcccaagacgtaccatctggctgtctcgaagccagtcagatatcttttcccgtaagcccccacgtacagtgagtgtcttggacccatactaccggccacgagatggtgctgcccgcacccccaaagtcaacccttttagtgctcgccaggacctcatggggggcaagatcaagttttttgacctgcccagcaagtctgtcatctctctggtatttgacctggatgcaccagggcccggaactatgcccctggctgactggcaggagcccctggccccacctattcgccggtggcgttccttgcctggttcgcctgagttcttgcatcaagaggcttgtccatttgtgggccgggaagaatcgctatctgatgggcccccaccacgcctaagtagtctcaagtacagagttaaagagatcccaccattccgggcatctgccctaccagctgctcaagcccatgaggctatggactgctccattctccaggaagaaaatggttttgggtccaggccccaggggaccagtccatgccctgcgggtgcttctgaggagatggaggtagaagaaaggccagcaggctcaactccagccaccttctccacctcaggcataggcctgcaaacccagggaaagcaggatgggtgagggggtttagtccctgcctcaccttggggatggaccttcagctgaaaccatatggccccctaggtgcacagccttgattcttccctggagcctacagagcaggcaggctaggccaagccaggctcaacttctgggctcccagtgcccattggctgtgtatgacgggaggcagcagtgagaggccttcctagttagggccaacagctgataccaagcctctgaaatccagcaaggaggtctgcctcccaccagaccctctccagtgtacttccccagataggaccagaggatgtctagttctaggctgagctggcaggcagctattaccccggttctttccccaccccaggtctgtctcttgccttttcttggggcatataagctactgagtggaacatggagctgatcaagaggccgtaatggtcatggctgtttcccagacctgaatattggggtgcttcttgccagtattctaagacatttgagtaattgctgtttgcacttactgcatggtcagaccacgtcactacatttctatgcaaggggacagcaaggcagcgtggtggtcatggctcttagctaacctattcaaagaccttttcctgttgattaatctattttcatatttataaaggagtcttaatgttctgccccataagactttcaaccttgtggttgggagtggggctggttttgtaggccctagggcctgcttctatgtatttatcaacatgtgatacattcaattggttaaatggtttatacagggactgatttgcttcccttcctgccatggctggagctttgggaacagtctgtccttacagagctgcaataagaaataaccaaagatgaagctggtcaaatattttcataacttgcttctgttgatttttttttttgtaaaactttcccaagacattttcagacttaaaaataaagtcagtgttacaggtg

SEQ ID NO: 291795 - DNA, 3025 bp, Homo sapiens
gaattcgcggccgctcgacgctcagcagagctaccagctgccctgttggcttcgctggtcggatcgtcctcctggccccgccaaacaggcggggggagcggccccgactgtggggccatggcagtagtctcctcgttctccgccgccgctagcctagctgagtcgccggcttctgcgctaggggctcccaccgcctccgcaggctaaggagccgctgccaccaacgagctgtgagggttactatgctccctctttgccgccgtctcctcctcttgcccgcgcaggcacccctctggctgctcagtcctgcctcagtgtcaaaccagaagagaagtaaaattcaacaaaaatttatgtgtggagttccttcttaaaagaagaaaaaagtgattatttagactatggatcggagcaaacggaattcaattgcaggatttcctccacgtgtggagcgtcttgaagagtttgaaggaggtggtggaggagaaggaaatgtgagccaggtgggaagagtttggccatcttcgtatcgagctcttataagtgccttttccagactgacgcgtttggatgatttcacctgtgaaaaaatagggtctggcttcttttctgaagtgttcaaggtacgacaccgagcttctggtcaggtgatggctcttaagatgaacacattgagcagtaaccgggcaaacatgctgaaagaagtacagctcatgaatagactctcccatcccaacatccttagtatatcaactccgggaacctggaacagttgctagacagtaacctgcatttgccttggactgtgagggtaaaactggcctatgacatagcagtgggcctcagctaccttcacttcaaaggcatttttcatcgggacctcacatctaagaactgcctgataaagagggatgagaatggttactctgcagtggtagctgactttggcctggctgagaagatccccgatgtcagcatggggagtgagaagctggccgtggtgggttccccattctggatggcacctgaggttctccgagatgagccctataatgaaaaggcagatgtgttctcttatggtatcatcctctgcgagatcatcgcccgcatccaggccgatccggactatcttccccgcacagagaatttcgggctggactatgatgctttccagcacatggtgggagactgtcccccagattttctgcaacttactttcaactgctgtaacatggatcccaaactgcgcccatcttttgtggagattgggaagaccctggaggaaattctgagccgcctacaggaagaagagcaggagagggataggaagctgcagcccacagccaggggactcttggagaaagcacctggggtgaagcgactaagctcactggatgacaagatcccccacaagtcaccatgcccaagacgtaccatctggctgtctcgaagccagtcagatatcttttcccgtaagcccccacgtacagtgagtgtcttggacccatactaccggccacgagatggtgctgcccgcacccccaaagtcaacccttttagtgctcgccaggacctcatggggggcaagatcaagttttttgacctgcccagcaagtctgtcatctctctggtatttgacctggatgcaccagggcccggaactatgcccctggctgactggcaggagcccctggccccacctattcgccggtggcgttccttgcctggttcgcctgagttcttgcatcaagaggcttgtccatttgtgggccgggaagaatcgctatctgatgggcccccaccacgcctaagtagtctcaagtacagagttaaagagatcccaccattccgggcatctgccctaccagctgctcaagcccatgaggctatggactgctccattctccaggaagaaaatggttttgggtccaggccccaggggaccagtccatgccctgcgggtgcttctgaggagatggaggtagaagaaaggccagcaggctcaactccagccaccttctccacctcaggcataggcctgcaaacccagggaaagcaggatgggtgagggggtttagtccctgcctcaccttggggatggaccttcagctgaaaccatatggccccctaggtgcacagccttgattcttccctggagcctacagagcaggcaggctaggccaagccaggctcaacttctgggctcccagtgcccattggctgtgtatgacgggaggcagcagtgagaggccttcctagttagggccaacagctgataccaagcctctgaaatccagcaaggaggtctgcctcccaccagaccctctccagtgtacttccccagataggaccagaggatgtctagttctaggctgagctggcaggcagctattaccccggttctttccccaccccaggtctgtctcttgccttttcttggggcatataagctactgagtggaacatggagctgatcaagaggccgtaatggtcatggctgtttcccagacctgaatattggggtgcttcttgccagtattctaagacatttgagtaattgctgtttgcacttactgcatggtcagaccacgtcactacatttctatgcaaggggacagcaaggcagcgtggtggtcatggctcttagctaacctattcaaagaccttttcctgttgattaatctattttcatatttataaaggagtcttaatgttctgccccataagactttcaaccttgtggttgggagtggggctggttttgtaggccctagggcctgcttctatgtatttatcaacatgtgatacattcaattggttaaatggtttatacagggactgatttgcttcccttcctgccatggctggagctttgggaacagtctgtccttacagagctgcaataagaaataaccaaagatgaagctggtcaaatattttcataacttgcttctgttgatttttttttttgtaaaactttcccaagacattttcagacttaaaaataaagtcagtgttacaggtg

SEQ ID NO: 291796 - DNA, 2043 bp, Homo sapiens
  misc_feature (9)..(9): n is a, c, g, or t
ctaccgggnttcgagtgaagcgactaagctcactggatggcacctgaggttctccgagatgagccctataatgaaaaggcagatgtgttctcttatggtatcatcctctgcgagatcatcgcccgcatccaggccgatccggactatcttccccgcacagagaatttcgggctggactatgatgctttccagcacatggtgggagactgtcccccagattttctgcaacttactttcaactgctgtaacatggatcccaaactgcgcccatcttttgtggagattgggaagaccctggaggaaattctgagccgcctacaggaagaagagcaggagagggataggaagctgcagcccacagccaggggactcttggagaaagcacctggggtgaagcgactaagctcactggatgacaagatcccccacaagtcaccatgcccaagacgtaccatctggctgtctcgaagccagtcagatatcttttcccgtaagcccccacgtacagtgagtgtcttggacccatactaccggccacgagatggtgctgcccgcacccccaaagtcaacccttttagtgctcgccaggacctcatggggggcaagatcaagttttttgacctgcccagcaagtctgtcatctctctggtatttgacctggatgcaccagggcccggaactatgcccctggctgactggcaggagcccctggccccacctattcgccggtggcgttccttgcctggttcgcctgagttcttgcatcaagaggcttgtccatttgtgggccgggaagaatcgctatctgatgggcccccaccacgcctaagtagtctcaagtacagagttaaagagatcccaccattccgggcatctgccctaccagctgctcaagcccatgaggctatggactgctccattctccaggaagaaaatggttttgggtccaggccccaggggaccagtccatgccctgcgggtgcttctgaggagatggaggtagaagaaaggccagcaggctcaactccagccaccttctccacctcaggcataggcctgcaaacccagggaaagcaggatgggtgagggggtttagtccctgcctcaccttggggatggaccttcagctgaaaccatatggccccctaggtgcacagccttgattcttccctggagcctacagagcaggcaggctaggccaagccaggctcaacttctgggctcccagtgcccattggctgtgtatgacgggaggcagcagtgagaggccttcctagttagggccaacagctgataccaagcctctgaaatccagcaaggaggtctgcctcccaccagaccctctccagtgtacttccccagataggaccagaggatgtctagttctaggctgagctggcaggcagctattaccccggttctttccccaccccaggtctgtctcttgccttttcttggggcatataagctactgagtggaacatggagctgatcaagaggccgtaatggtcatggctgtttcccagacctgaatattggggtgcttcttgccagtattctaagacatttgagtaattgctgtttgcacttactgcatggtcagaccacgtcactacatttctatgcaaggggacagcaaggcagcgtggtggtcatggctcttagctaacctattcaaagaccttttcctgttgattaatctattttcatatttataaaggagtcttaatgttctgccccataagactttcaaccttgtggttgggagtggggctggttttgtaggccctagggcctgcttctatgtatttatcaacatgtgatacattcaattggttaaatggtttatacagggactgatttgcttcccttcctgccatggctggagctttgggaacagtctgtccttacagagctgcaataagaaataaccaaagatgaagctggtcaaatattttcataacttgcttctgttgatttttttttttgtaaaactttcccaagacattttcagacttaaaaataaagtcagtgttacaggtg

SEQ ID NO: 291797 - DNA, 1043 bp, Homo sapiens
ggctttttaaatgacccaggcgtggggcagccaccttctccacctcaggcataggcctgcaaacccagggaaagcaggatgggtgagggggtttagtccctgcctcaccttggggatggaccttcagctgaaaccatatggccccctaggtgcacagccttgattcttccctggagcctacagagcaggcaggctaggccaagccaggctcaacttctgggctcccagtgcccattggctgtgtatgacgggaggcagcagtgagaggccttcctagttagggccaacagctgataccaagcctctgaaatccagcaaggaggtctgcctcccaccagaccctctccagtgtacttccccagataggaccagaggatgtctagttctaggctgagctggcaggcagctattaccccggttctttccccaccccaggtctgtctcttgccttttcttggggcatataagctactgagtggaacatggagctgatcaagaggccgtaatggtcatggctgtttcccagacctgaatattggggtgcttcttgccagtattctaagacatttgagtaattgctgtttgcacttactgcatggtcagaccacgtcactacatttctatgcaaggggacagcaaggcagcgtggtggtcatggctcttagctaacctattcaaagaccttttcctgttgattaatctattttcatatttataaaggagtcttaatgttctgccccataagactttcaaccttgtggttgggagtggggctggttttgtaggccctagggcctgcttctatgtatttatcaacatgtgatacattcaattggttaaatggtttatacagggactgatttgcttcccttcctgccatggctggagctttgggaacagtctgtccttacagagctgcaataagaaataaccaaagatgaagctggtcaaatattttcataacttgcttctgttgatttttttttttgtaaaactttcccaagacattttcagacttaaaaataaagtcagtgttacaggtg

SEQ ID NO: 291798 - DNA, 994 bp, Homo sapiens
gaattcgcggccgctcgacgctcagcagagctaccagctgccctgttggcttcgctggtcggatcgtcctcctggccccgccaaacaggcggggggagcggccccgactgtggggccatggcagtagtctcctcgttctccgccgccgctagcctagctgagtcgccggcttctgcgctaggggctcccaccgcctccgcaggctaaggagccgctgccaccaacgagctgtgagggttactatgctccctctttgccgccgtctcctcctcttgcccgcgcaggcacccctctggctgctcagtcctgcctcagtgtcaaaccagaagagaagtaaaattcaacaaaaatttatgtgtggagttccttcttaaaagaagaaaaaagtgattatttagactatggatcggagcaaacggaattcaattgcaggatttcctccacgtgtggagcgtcttgaagagtttgaaggaggtggtggaggagaaggaaatgtgagccaggtgggaagagtttggccatcttcgtatcgagctcttataagtgccttttccagactgacgcgtttggatgatttcacctgtgaaaaaatagggtctggcttcttttctgaagtgttcaaggtacgacaccgagcttctggtcaggtgatggctcttaagatgaacacattgagcagtaaccgggcaaacatgctgaaagaagtacagctcatgaatagactctcccatcccaacatccttaggtcctagtccaatggaggttgggtagaggtggaaggagagctcattttcacctagaagagggcctcaggttcctccactggatcttctgcatctgctggcagatgaaggaagaagctgtggaaaatagtgttgaggttttatggaacaggcctagaaatgacataatcacttctgcccatataccactggccagaacttagtgttacagtcttaaccaactataataaacactgggaaatgtaatctac

SEQ ID NO: 291799 - DNA, 338 bp, Homo sapiens
ctgttctgtccctgggatggacttgctggaactctctgttgctggttgtcaggggcagctcccaaccacttctactgagcaggctaggatgggtggggggattaatgaactgtctacctatgctttccatacccatccacagaatttcgggctggactatgatgctttccagcacatggtgggagactgtcccccagattttctgcaacttactttcaactgctgtaacgtgagtgtctttctccctctgcctttcatcaggggctggctgaacccttttcacctggttaggactgtacagagaggctgctaattagcttcatgagggacctcatttt

SEQ ID NO: 291800 - DNA, 477 bp, Homo sapiens
cccctatattgcaagctccaagaggacaagggttttggttgttttcatctagctatttctagcacttaaaattatgcctagcacttagaaagcaaagatgagtaattgtgtttggaatgtgaagtgtatcctaggacagccacccaagacccaggactaactcatctcacctggctgtcttagagcccctgacctgaccagtggggtcagcttgagtgcggttcaccaaggagcagaggacaaggtgccctgtgataggaaggggggaatgggtggtaactctatggctgatccccgcttctgagccacattattttctcttccttcctgggaaccctagaactgcctgataaagagggatgagaatggttactctgcagtggtagctgactttggcctggctgagaagatccccgatgtcaggtgtgtagccctactggatgctggggtccaagggacagggggctgaagctaagg

SEQ ID NO: 291801 - DNA, 356 bp, Homo sapiens
tttttttttttcaaaagattctgaattgttccctttacaccttttctgttgtagaaggattcatgaaccagcgtggagccagggtgtcttctcccatcctcatcatttcctatgagaccttccgccttcatgttggagtcctccagaaaggaagtgttggtctggtcatatgtgacgaggtacttgactctcagcagttggacagcttgaacaccagccggcgggtgctcatctccggaactcccatccagaatgatctgcttgagtatttcagcttggtacattttgttaattccggcatcctaggtaagaatctagccttgtttgccacatcagagaggagccctgccttgtct

SEQ ID NO: 291802 - DNA, 3230 bp, Homo sapiens
agccaatgggtgatacgacggcagcgcggcgggaggttcgattgacccggtcttggcgggtcggtgagtcttggcggctgttaacgcgcgctttgggaacaggaaggttgagagagaggtgctggggtctgcgtctatctctgtcgctcttttcagcccctcctggtattcccctcctaacctgggttttttacacgcccgcgtggcttcctgctcgacctccctgagtctgatcctggtttccacctccagccctgggaaatttcctttctccagactcgccctccccacccgggcctcggactttcaccccagcttctctctcctggccagtgattacccacccccgaatcccaccccgccccgccgcgcaactacctcctcccttcacccggactgggaccatcatccccactccactccgcccagtctgggactccacctgcctcctccccaatcccacactaatctctgcttggtctcttcctctttggcctaatctctcgtctcggcttattggggacggccactctcacagtttggttccaaacaccagttcctggatggattcccgccatccatgccccctctttaattagccggtcctctcaataatgtagcagccccctctacagattagaccctggtcctacactcttagccgctgcctgcttttgacctttggctcatgggtacttgacgttttaaactcctaggcccaggatgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggctggtgacagtcagggatgcccccggcacacagggactaggtctagtgagaacatcaggagcagccagggatcc

SEQ ID NO: 291803 - DNA, 2572 bp, Homo sapiens
accacgcgtcgcggacgcgtgggtcgacccacgcgtcggaacaggaaggttgagagagaggtgctgggaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggctggtgacagtcagggatgcccccggcacacagggactaggtctagtgagaacatcaggagcagccagggatcc

SEQ ID NO: 291804 - DNA, 2365 bp, Homo sapiens
agccaatgggtgatacgacggcagcgcggcgggaggttcgattgacccggtcttggcgggtcgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggctggtgacagtcagggatgcccccggcacacagggactaggtctagtgagaacatcaggagcagccagggatcc

SEQ ID NO: 291805 - DNA, 2062 bp, Homo sapiens
ctttccggtacccgggtttctcgagttttctccgcgtgtcttttgggggctcccctgttttcccctttgtcacgagaccttgtgtcctggaccccgtttggcgcccgtgcgcccttctcttgcccctcgttttcccgcccccccttttgttcctcccgagtttttttttttttttttttttttttttgagatggagtcttgctcttgttgcccaagctggaatgcaatggggcgatctcggctcactgcaacctccacctcctgggttcaagtgattctcctgcctcagcttcccgagtagctgggtttacaggtgcctgccaccacacttggctaattttcgtatttttagtagagatggggtttctccattttggccaggctggtcttgaactcctgaccacaggtgatccgcccgcctcagcttcccaaagtgctgggattactggcgtgagccactgcgcctggccgagtctctgacatttaatactgtaaaagagggctagtcttggtcctttgggtggtagcttttattccagtagttagcatggcaattttaccagcctcttgcctttttatcctgttttctctagatgcctgatacggaggacttctgatatcctttctaaatatctgcctgtgaagattgagcaggtcgtttgttgtaggtactgaactcaactgaaagatgtggagtgggtcaaagcctagctcctgaagcatggctgggctctcaaggtgttctcagagggcaggagggtggtctagctttttccactgacccagctgccttttttaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggctggtgacagtcagggatgcccccggcacacagggactaggtctagtgagaacatcaggagcagccagggatcc

SEQ ID NO: 291806 - DNA, 2040 bp, Homo sapiens
agccaatgggtgatacgacggcagcgcggcgggaggttcgattgacccggtcttggcgggtcgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaatggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggctggtgacagtcagggatgcccccggcacacagggactaggtctagtgagaacatcaggagcagccagggatcc

SEQ ID NO: 291807 - DNA, 2343 bp, Homo sapiens
agccaatgggtgatacgacggcagcgcggcgggaggttcgattgacccggtcttggcgggtcggtgagtcttggcggctgttaacgcgcgctttgggaacaggaaggttgagagagaggtgctggggtctgcgtctatctctgtcgctcttttcagcccctcctggtattcccctcctaacctgggttttttacacgcccgcgtggcttcctgctcgacctccctgagtctgatcctggtttccacctccagccctgggaaatttcctttctccagactcgccctccccacccgggcctcggactttcaccccagcttctctctcctggccagtgattacccacccccgaatcccaccccgccccgccgcgcaactacctcctcccttcacccggactgggaccatcatccccactccactccgcccagtctgggactccacctgcctcctccccaatcccacactaatctctgcttggtctcttcctctttggcctaatctctcgtctcggcttattggggacggccactctcacagtttggttccaaacaccagttcctggatggattcccgccatccatgccccctctttaattagccggtcctctcaataatgtagcagccccctctacagattagaccctggtcctacactcttagccgctgcctgcttttgacctttggctcatgggtacttgacgttttaaactcctaggcccaggatgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggctggtgacagtcagggatgcccccggcacacagggactaggtctagtgagaacatcaggagcagccagggatcc

SEQ ID NO: 291808 - DNA, 3172 bp, Homo sapiens
accacgcgtcgcggacgcgtgggtcgacccacgcgtcggaacaggaaggttgagagagaggtgctggggtctgcgtctatctctgtcgctcttttcagcccctcctggtattcccctcctaacctgggttttttacacgcccgcgtggcttcctgctcgacctccctgagtctgatcctggtttccacctccagccctgggaaatttcctttctccagactcgccctccccacccgggcctcggactttcaccccagcttctctctcctggccagtgattacccacccccgaatcccaccccgccccgccgcgcaactacctcctcccttcacccggactgggaccatcatccccactccactccgcccagtctgggactccacctgcctcctccccaatcccacactaatctctgcttggtctcttcctctttggcctaatctctcgtctcggcttattggggacggccactctcacagtttggttccaaacaccagttcctggatggattcccgccatccatgccccctctttaattagccggtcctctcaataatgtagcagccccctctacagattagaccctggtcctacactcttagccgctgcctgcttttgacctttggctcatgggtacttgacgttttaaactcctaggcccaggatgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggctggtgacagtcagggatgcccccggcacacagggactaggtctagtgagaacatcaggagcagccagggatcc

SEQ ID NO: 291809 - DNA, 2400 bp, Homo sapiens
gggcggacgcgtgggccggtcttggcgggtcgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaagggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggctggtgacagtcagggatgcccccggcacacagggactaggtctagtgagaacatcaggagcagccagggatcc

SEQ ID NO: 291810 - DNA, 1741 bp, Homo sapiens
taggctaggtacgaggccgggtgtgtgctccgagataagacatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggctggtgacagtcagggatgcccccggcacacagggactaggtctagtgagaacatcaggagcagccagggatcc

SEQ ID NO: 291811 - DNA, 1749 bp, Homo sapiens
atccactctggccatgtttgtctttttagtggactattcaatccatttacatttactctaagtaattatatatttggattttaacctatcatctcacttttggcctttcaagtcttcactgctttgatacctctctgatctgttaaacagaaattggcctatattttgtttagccttgttcttggtaggaaggctggtttgtgagaaggtagtctgccatcactagctgtgggaaaatcattccttttccacattcttctgttttccttctctcctgtgtttagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggctggtgacagtcagggatgcccccggcacacagggactaggtctagtgagaacatcaggagcagccagggatcc

SEQ ID NO: 291812 - DNA, 820 bp, Homo sapiens
tggggagccccacttatacttggaggtgtcctggcaccctacccactttttggtaggtgtttgggtgtccaaggctttgcagaagaagcaggcagggagtctatggtggagtaacgtggtggagaggcctggagaggtgtcattctagctgggcaacgggtgacacgcagtcatcccctcagtgaacgctggacgtgctctgtggctccctgcaggcctgcggatccaccagggggctccgttccttctgggccaaagctgaagaagcggctgctgcaccagagaagtgcatctggatgaaggtggaagcacacgcgggcccgcagaaccgcctaagatatcttcaggtgtgggcttggaactggcaggctttcatttctgcttcattccatggccaaagcaagccacatgggcaagtctgaagccggggcaagaaagtatcctccacccacaacgaaaccatggcaagcgggtagaatggaggttgcactattcgggccggccactctcctactggctgacaggatgctgcccgagatgaaacagggtgtgtgtgcaccacggagtcagtccaagactcctgttctcactcagggattcttcatttcttcttcctattgcctccacttcatgttattttcttcccttcccatttacaagtaaaactgaccagagccccaggaataaatggttttcttggcttcctccttgctcccatctggacccagtcccctggttcctgttggtcatttgcaaaccaagaggaccacaataaacaaatctctattttttttttaaatattaaagcattcactctgca

SEQ ID NO: 291813 - DNA, 441 bp, Homo sapiens
caatactcattggcatacattaacggtctgcagtcagctctcttagtctctgtgatggctattgcaaacttctgctggattcctttagccttgactatcatcagtatgaattgaagaaacaagattgtcctttgaactaaaatcctgttcatcctcattgtcactaccaacgactggaattcctgcaagatccccagagttcaaaaaataatcatcttcatccagcaatgaattttcagatcctgtttgattcggcattccataagacatgctgtcaagggtaggagttaagttgtggtctatatcttcagacatttctgtatccatgataccaccaccttaaaaagtaaaatactgtttagacaaatgatagtgctaaagatgaccacaatgataaggtcagtctggtatttaaccaaataaatattttttcaaacaaaa

SEQ ID NO: 291814 - DNA, 712 bp, Homo sapiens
ctttaacatggattgaagtaaaaatccaacaagagttaaataataacgatgacatccgcaacttgtattcttttagtaatattaacagaagatttccatcattttacttcaacttcaataactgttactgatctgaagtagtagttccttactatgatcaagaaaaaatctattctaagaaatgtctgaattacatgagatgtcttttggcatctaataaagtgactattacagatacccttatttgacctgctgatgaaatatatgtattaaaagattttctaacatcgactaatcatgacattccttcattatatagtgtattaaagaaaatttccttaaatatttttattttaatctcagaaaactccagaaacaaccaatactcattggcatacattaacggtctgcagtcagctctcttagtctctgtgatggctattgcaaacttctgctggattcctttagccttgagtacgtattatttatgtaatatagtaaaatagtatacatcttaagtactgtttgtatggtccacaatgccttcaaggcacaatcatgtttggtttatgtttggatcctcccatgatcactaattttacaagtatttgataaacaaatcaatgagtagccaaatactaataaatattttctgagaagtaaatatctaattggtaacccaaaagctttcagaagcagaaaaacacatgcc

SEQ ID NO: 291815 - DNA, 1740 bp, Homo sapiens
cctgaacgttgttattgtcacaaggctggctagatctccggcatctgcacactcagtctgaccatttgggaagctttcatgaaaaagcacagtcagcgagaatgagacgagagaacccatttccacaaccattttaatctgcgcatcggtcccagacgtagggattcctcgtctcatcttggaaacattgccagcagtggttctgatttggaagcctgcgtctgtcacgtgacaccgtctgagcctgtgcctgcctctctttcttccggcagtgccctgtactctgtggggatgacggcagtgggcctggccatcctgtgaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggtgcctctcttgaccagctaccctcccaggggaccatgaggaagctcagaggaaagacccccgcctgctcctgtctcacggagcccacagggtcacggagggcaatggagggtcattcgctctgctggggttgccttttgcactgaagatagagaccacctttttgagtgacttgagcccaaaggcaagcgtatatcaaacgatcttctccacataacctctctgtgccatcataagaatagctgcttccgcccccggatttgctcaggcctgggaatccgctgactgaaggcctcttgttgagtgccagctctaaacaagtccctttatgcagagccacagctgtgcatgctcagccctgccgaggtcccaggccaggctttgttgcttccgttcatggaagcgcacaggatagggccgacgctgtgccggtcgtggggaaatctcactggggaagagaaaagcccaagccttgttggttacgtcagccggtccatggcggtgtcctgcggaccccagagcccccgggaagggcgcaagtcaaagagcactggaggcaccgccggcgatggacgtccaggtcccggctcctgtgctggaaagcgttgatggggagcgtcggcgctgaccacacgcgggagctgcggaagcccagcggttcacacaggcctcccttcaacgtagtcatcccctggtggtggaagcaagacgacggcccctgacgtgcagccacacacagaaaaggctgctgtgaacattttatgcttcgactttttttttcttcagagacagggtgtcgttctgtcgcccaggctggagtgcagtgccaccatcatagctcactgcagcctccacctcctaggctcaagcttcctaagtagttgggactcaaggcttgagtcaccatgccaggctctgttttttcagtctgtgaaaaataaagtcatcagcatgtga

SEQ ID NO: 291816 - DNA, 2324 bp, Homo sapiens
aacttagctaggtagagctggtttgaatcggacgagggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctgtaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggtgcctctcttgaccagctaccctcccaggggaccatgaggaagctcagaggaaagacccccgcctgctcctgtctcacggagcccacagggtcacggagggcaatggagggtcattcgctctgctggggttgccttttgcactgaagatagagaccacctttttgagtgacttgagcccaaaggcaagcgtatatcaaacgatcttctccacataacctctctgtgccatcataagaatagctgcttccgcccccggatttgctcaggcctgggaatccgctgactgaaggcctcttgttgagtgccagctctaaacaagtccctttatgcagagccacagctgtgcatgctcagccctgccgaggtcccaggccaggctttgttgcttccgttcatggaagcgcacaggatagggccgacgctgtgccggtcgtggggaaatctcactggggaagagaaaagcccaagccttgttggttacgtcagccggtccatggcggtgtcctgcggaccccagagcccccgggaagggcgcaagtcaaagagcactggaggcaccgccggcgatggacgtccaggtcccggctcctgtgctggaaagcgttgatggggagcgtcggcgctgaccacacgcgggagctgcggaagcccagcggttcacacaggcctcccttcaacgtagtcatcccctggtggtggaagcaagacgacggcccctgacgtgcagccacacacagaaaaggctgctgtgaacattttatgcttcgactttttttttcttcagagacagggtgtcgttctgtcgcccaggctggagtgcagtgccaccatcatagctcactgcagcctccacctcctaggctcaagcttcctaagtagttgggactcaaggcttgagtcaccatgccaggctctgttttttcagtctgtgaaaaataaagtcatcagcatgtga

SEQ ID NO: 291817 - DNA, 585 bp, Homo sapiens
cgagggaccctgaccgcgccccgcttcctttccataacgagtggacccctcccggagcaccttcagcccttcctccacgggagacccccccagcgccggcacgagagatgccagcggacccccacccctgacacacctgcgccgcctccgaaacgcgatctgtccggcgcctcccctcgggcgccttctcccccgagccggccgggagccgggacgggggcgcgcagggtccgggagagttacaggcttcagactttatctcgttgtggaaagcaagagaccaagccaaaaactttggtcgtgcttttcaacatctccggtcaaaagaggtcgccaatctgcttttctcccattgctgcgtcttagaggggtgtggtgccatgataccacttttgaaaatcctgttgaatgcaagtcctctttgttgctcattgaacaatgaggatatttagctcccctcagagctaccctcagagttggatgagctatcctcagagttggatgccaccaccgggagcagcaaaagcgaaggcaactcatgattctgcctcagaagcaatcgaataaaatattttgaaaatgaaa

SEQ ID NO: 291818 - DNA, 509 bp, Homo sapiens
tggccgcgggaaggctggagccgttctggctggcaccggggtctacgccctcctgccggaggctggctctcgcctctgctcccttcctgggttctgcgccgccacccctcacccacgccgcttatcttccctccctttgcacgctcccgcgggacagggagagttacaggcttcagactttatctcgttgtggaaagcaagagaccaagccaaaaactttggtcgtgcttttcaacatctccggtcaaaagaggtcgccaatctgcttttctcccattgctgcgtcttagaggggtgtggtgccatgataccacttttgaaaatcctgttgaatgcaagtcctctttgttgctcattgaacaatgaggatatttagctcccctcagagctaccctcagagttggatgagctatcctcagagttggatgccaccaccgggagcagcaaaagcgaaggcaactcatgattctgcctcagaagcaatcgaataaaatattttgaaaatgaaa

SEQ ID NO: 291819 - DNA, 489 bp, Homo sapiens
cgagggaccctgaccgcgccccgcttcctttccataacgagtggacccctcccggagcaccttcagcccttcctccacgggagacccccccagcgccggcacgagagatgccagcggacccccacccctgacacacctgcgccgcctccgaaacgcgatctgtccggcgcctcccctcgggcgccttctcccccgagccggccgggagccgggacgggggcgcgcagggtccggtcgccaatctgcttttctcccattgctgcgtcttagaggggtgtggtgccatgataccacttttgaaaatcctgttgaatgcaagtcctctttgttgctcattgaacaatgaggatatttagctcccctcagagctaccctcagagttggatgagctatcctcagagttggatgccaccaccgggagcagcaaaagcgaaggcaactcatgattctgcctcagaagcaatcgaataaaatattttgaaaatgaaa

SEQ ID NO: 291820 - DNA, 714 bp, Homo sapiens
gtatttttggtagagatggggtttcgccatgctggccaggctggcctcgaactcctggcctcaagtgatctgcccacctagcccaaccaaagtgttgggattacaggtgtgagccaccgtacttggcttccttttctatttttgagacagagtctcactctgtcactcaggctggagtgcagtggcacgatcttggctcactgcaacctctgcctcccaggttcaagtgatccttctgcctcaccctcccaagtagctgggattacaggtgtgcacctccgtggctagccctccttttcaattggttagtgtcttgtggttttcccacctttccacagtggaaaatggctcaggactgactgacatgaagacaagcccaggggtctacactcaactcaacccttgcacccaagctctgggctaagattttggcgtgctgagcaccacccattttgtaaggaattttgtaaaattttatctgaagcatcactcacaactccactttctttacttaaataaggatttccgccccatttctgccaggcatactgagcttcacagtccctgtttctttttcctggtgcctaggcctggttctctgagcctggtggtcacaccaatggcatctggcacacagttctccgataatggggatacctaggaggttccgagacaccttacagtcctgggttagtaacctggatctctttttcc

SEQ ID NO: 291821 - DNA, 899 bp, Homo sapiens
tgcctcatagtgcgcatgcttgagcccacttacctaacacctgagatcttattgggacgctgctgataaccagtttcagagatgctcaagcactgaattgtcttaagaaaacaagtaaggttttgtcacctatcctatttctcactgcaagttgaaaaaaatcaaatccaaacaccaccaccccttctatgacaacaaacggctgtggaggtaatcttattttcctaagggtagtttcatgatgacagtgtcaaaaaattactgtggataaagaaaaaattgtctcaatgaaatagaatttttcactgaacacagaaaccatctcaatagttgctgctccctggtttccaggccacgcaacagacatcaaaccaggaagccaaactttcatggacctgtgttaagaaaaacacacatacatgggcatactactttttccagaaaaacggaattaggcagagaaggaagtgtgggtgtacaactgatccacaagctattgggaaatcaatagctaaaaaatgtcaacaccctggcttccttttatcaggaactccaggaggctgaaggaatgtgagtgcatgagataagcaagacagatcttaacggtcccctcacatccctttctgggcaatctccagaatgcctagttttgtggagacaccatgtactatctggctgcagagactttcttaggtcccgtgttagaccccatggggtctcagcatgtggtcatgtggtaatgcattcctttcaaaggctttgggttgaactcaagttggaaatacctggaaaagaccaagcttctcctttgggtgtctgcggatcctattaaaaatattcgtgatgttttaagttctccaatacaattttctccatgaaaacaagcatcagatacacta

SEQ ID NO: 291822 - DNA, 1132 bp, Homo sapiens
actgcactcttaatacttatctttattatgaaagtgtttccaaagtaaaatgatcctcataataatgattgcttccagagatcaagaatgaataattatattttcatataaaaatcagcaaaacacaataacaatacataaaataattctaattggctaacagtatttcattccatttctgacagagatgctcaagcactgaattgtcttaagaaaacaagtaaggttttgtcacctatcctatttctcactgcaagttgaaaaaaatcaaatccaaacaccaccaccccttctatgacaacaaacggctgtggaggtaaatgactatgtgggcaaagagttgatgaaaatcatgagcttaggggctttatgaaactttgggaaatcaaactcagaggttgttttccattcttaaagtaatgaagctctaagttaaagtttcagaatcatcacataactgttcctattccataactcatttcttttttttttttgcaggtaatcttattttcctaagggtagtttcatgatgacagtgtcaaaaaattactgtggataaagaaaaaattgtctcaatgaaatagaatttttcactgaacacagaaaccatctcaatagttgctgctccctggtttccaggccacgcaacagacatcaaaccaggaagccaaactttcatggacctgtgttaagaaaaacacacatacatgggcatactactttttccagaaaaacggaattaggcagagaaggaagtgtgggtgtacaactgatccacaagaactccaggaggctgaaggaatgtgagtgcatgagataagcaagacagatcttaacggtcccctcacatccctttctgggcaatctccagaatgcctagttttgtggagacaccatgtactatctggctgcagagactttcttaggtcccgtgttagaccccatggggtctcagcatgtggtcatgtggtaatgcattcctttcaaaggctttgggttgaactcaagttggaaatacctggaaaagaccaagcttctcctttgggtgtctgcggatcctattaaaaatattcgtgatgttttaagttctccaatacaattttctccatgaaaacaagcatcagatacacta

SEQ ID NO: 291823 - DNA, 1187 bp, Homo sapiens
actgcactcttaatacttatctttattatgaaagtgtttccaaagtaaaatgatcctcataataatgattgcttccagagatcaagaatgaataattatattttcatataaaaatcagcaaaacacaataacaatacataaaataattctaattggctaacagtatttcattccatttctgacagagatgctcaagcactgaattgtcttaagaaaacaagtaaggttttgtcacctatcctatttctcactgcaagttgaaaaaaatcaaatccaaacaccaccaccccttctatgacaacaaacggctgtggaggtaaatgactatgtgggcaaagagttgatgaaaatcatgagcttaggggctttatgaaactttgggaaatcaaactcagaggttgttttccattcttaaagtaatgaagctctaagttaaagtttcagaatcatcacataactgttcctattccataactcatttcttttttttttttgcaggtaatcttattttcctaagggtagtttcatgatgacagtgtcaaaaaattactgtggataaagaaaaaattgtctcaatgaaatagaatttttcactgaacacagaaaccatctcaatagttgctgctccctggtttccaggccacgcaacagacatcaaaccaggaagccaaactttcatggacctgtgttaagaaaaacacacatacatgggcatactactttttccagaaaaacggaattaggcagagaaggaagtgtgggtgtacaactgatccacaagctattgggaaatcaatagctaaaaaatgtcaacaccctggcttccttttatcaggaactccaggaggctgaaggaatgtgagtgcatgagataagcaagacagatcttaacggtcccctcacatccctttctgggcaatctccagaatgcctagttttgtggagacaccatgtactatctggctgcagagactttcttaggtcccgtgttagaccccatggggtctcagcatgtggtcatgtggtaatgcattcctttcaaaggctttgggttgaactcaagttggaaatacctggaaaagaccaagcttctcctttgggtgtctgcggatcctattaaaaatattcgtgatgttttaagttctccaatacaattttctccatgaaaacaagcatcagatacacta

SEQ ID NO: 291824 - DNA, 786 bp, Homo sapiens
gcggcggcagcggccggaggaggcggaggaggcggaggaggcggaggtggaagaggaagccggcgtggacgaggcggaggagagagaggcgggccgcgggcgcaggctgtccggcggaggctcagcgcgctccgggggcgggggcggcggcggcggctgaagaggctgcggcgcgctcaggagaccagcggcgccgctgcccttgagcgggcctgcgcctccgtgagggaagagttgctgccagtgctgcagttttctgaacctgggaaacgtgctgttcagacttcatccgggtctcattcaggatgcttcgatgttggttggaagagagttagaccgaaaatgttttgactggcgtcgttatgacaaggtcatccgtcattgttggatagattgatagcacccaagtttaaggcagacaccacgagggaaagcccacggcgctgtggtcccggaggctaaccaggcagtgtccgcagacctccagcaactccatcgggaggagaggatgaagttccaggcccgtttcaattaatctgctcgcagaactgccgaagagtggcttgtcgggccacgggagaagaaacaaatgctctttctcacactctcctggttcattgctgagaaaccaggacactcctctgttccctgggagagacagtgaactccagggatggaagtccggactccggcggcggtcccgtcatttgccttcttgtttctgcccaaacccagctagttccaagcgcttggtccccaagactggaagtccccaagaacctacct

SEQ ID NO: 291825 - DNA, 803 bp, Homo sapiens
tttgcaggaagtttgatggcatgtctttatatcatggccatgggcaggacttggaaaaagttttaccactaaagcatctatgaactcaagaaagaaaacactggctatgtacaatgatgactgtgatcttttaaatttatctcaaatagcgaacctaccagtcatacaatcttattggaggaagtgatttaaccaactcacagttaagtgtccttcatgatgatctgggaaatgaatgaataagtactctgtggctaccagttgcattatggagtcacctaggaattccattctctgattgtggcctctggaaaaagaaacatcaaagtaaagaaatcaataaccatttatggatttccaaaaaaacacccagaattttaaaaaaggaatgacttaaaaagacaatgtgttcattttgttttaaagcacaaaaccaaatacaattccctaaggcccctcgattgagaagagatctgagttaatataggctgagttttaaagaagaataaagtgaatattatctaaggattaaacgattgccaaaataaagactggtaaacactgcctggtcagaagctgaagagcataaattgaaaaatcaagcataatacaaacaacaatcttgaaagaaagcaaacaggtccaagacttttctttgctaaatttattgaaatatatactctggccggctgcagtggctcatgcctctaatcccagtgctttgtgaggctgaggcaggtggatcacttgagcccaggagtttgagaccagcctggcaacatgaagaaaccccatctctacaa

SEQ ID NO: 291826 - DNA, 639 bp, Homo sapiens
agtcagggaacatctgtcccttcttcgtgaatatctgtgttcaagtctcttgctcatttgttaaattgggcttttcatcttaattttggtttgcagttttctcccctatatccgaggtctgagtcctttgtcaggacacacagtgtgatttcttgcctggcattccgttccttgcttgtccattttcaagagcagaacattttcacgttgatggaagcccgatgtctttcttctacgacacaggtggtggccagacctggcacacggatgcagctgaccctggaagctgaagggcagtgaaacccatctgattaagatgctcaacttttctgaagaaaaagctgacaccaagacctgcctaaggtcacaccatcatgagtggctgagttgggctgtgatgagccacccggctggagagcttgtgccctggttacacgattgccagtgagatgcctatggactcgcatgtagaggtgggtacccagacagctcagagtgagctgcctgcgggcccagcatgcagaggtgtgtactcagtgctgtgtgagatgcctgtgggcccaggcacggagggatgcatgcgtgcccagaaagcaaaaggctgtgcagaggacctgctaggaggtaatgactagagaa

SEQ ID NO: 291827 - DNA, 984 bp, Homo sapiens
agtcagggaacatctgtcccttcttcgtgaatatctgtgttcaagtctcttgctcatttgttaaattgggcttttcatcttaattttggtttgcagttttctcccctatatccgaggtctgagtcctttgtcaggacacacagtgtgatttcttgcctggcattccgttccttgcttgtccattttcaagagcagaacattttcacgttgatggaagcccgatgtctttcttctacggtatgtgctctgcatccaaagcagccttcgcccatcccacattttagataattttttcttctaaaaacttcactgtttaagcgctcatgtttggatctgcaatctattttggatgaattcttgtgtatgacgtgcagtaggaataaaggctcatgtctttccatacggatagccagttttattcacagacacaggtggtggccagacctggcacacggatgcagctgaccctggaagctgaagggcagtgaaacccatctgattaagatgctcaacttttctgaagaaaaagctgacaccaagacctgcctaaggtcacaccatcatgagtggctgagttgggctgtgatgagccacccggctggagagcttgtgccctggttacacgattgccagtgagatgcctatggactcgcatgtagagagtgagtgcagcagtgacagcttggtgggctccagctgacccctccagagcccctgagtggtggcggtctgcagtcctcagtcagcagcagcagacgtcacccgtcatacagggccattcactgaagtgtcacctggtgcgcttggttggccagtcctaaggagcaacagacaggcatcggaggcacttgcagcagaaatatgaaaaacaaaacctacttagctgagctccccaagggcagggacaacttattttaacattgttttgaacttagtaagtttttaataaaatgatatgtaaatgaatggagcaaaagctctaga

SEQ ID NO: 291828 - DNA, 827 bp, Homo sapiens
agtcagggaacatctgtcccttcttcgtgaatatctgtgttcaagtctcttgctcatttgttaaattgggcttttcatcttaattttggtttgcagttttctcccctatatccgaggtctgagtcctttgtcaggacacacagtgtgatttcttgcctggcattccgttccttgcttgtccattttcaagagcagaacattttcacgttgatggaagcccgatgtctttcttctacggtatgtgctctgcatccaaagcagccttcgcccatcccacattttagataattttttcttctaaaaacttcactgtttaagcgctcatgtttggatctgcaatctattttggatgaattcttgtgtatgacgtgcagtaggaataaaggctcatgtctttccatacggatagccagttttattcacagacacaggtggtggccagacctggcacacggatgcagctgaccctggaagctgaagggcagtgaaacccatctgattaagatgctcaacttttctgaagaaaaagctgacaccaagacctgcctaaggtcacaccatcatgagtggctgagttgggctgtgatgagccacccggctggagagcttgtgccctggttacacgattgccagtgagatgcctatggactcgcatgtagaggtgggtacccagacagctcagagtgagctgcctgcgggcccagcatgcagaggtgtgtactcagtgctgtgtgagatgcctgtgggcccaggcacggagggatgcatgcgtgcccagaaagcaaaaggctgtgcagaggacctgctaggaggtaatgactagagaa

SEQ ID NO: 291829 - DNA, 867 bp, Homo sapiens
ctaatttttgtattttttttagagacagggtttcaccatgttgcccaggctggtcttgaacctctgggctcaagcaatctgcccaccttggcctcccaaagatctaggattataagtgtgagccacagtgcccagcctacatgctagagcatgtgactaaccctgtgactttacattggaattgcactttaacctgtttttaatgtttcttctgcattaacctgatatatctttattataatgctttattttcttcatgttagcttgcatttgaacatagataccttagtggtgtagtttgcttggctctgtggaagtagaataatatctccacgttcttattgttgatggttctgttgaagtatgtaatgttatatgtgactcatagatgaaccataatgacactgtagaaaaatggtggttttcttcacttttccaccatccacatttcttactatccctttagcttatccttcagtgacttaggtttttgtttgatggcaatccttaccattttttaagcctaattttagctgaatttaaaaggaggggtgaagagggtgaatgagatagaaaaacaagacatgatttttctgggtactctccctctagtctccatccttaacaagagtcttgcttatgacattattcaaaaagccagatacaacatccattacaaagtgacacacatctttggatggctgtttttgaagtatttcataaatctttttatactctctggatggagaaggcctttttaaacatgatactaaagttggaaaccaagaaaaaaagttggatggatttgattacataaaaatacagacttccttatggcaagaagaaaaaaaaaaaagaaacaaagtc

SEQ ID NO: 291830 - DNA, 410 bp, Homo sapiens
ggtatcgagctcggtaccagtgctactccacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggaggtagcactctgtttgtggagtagcactggaccgagctga

SEQ ID NO: 291831 - DNA, 427 bp, Homo sapiens
ctgatctagaggacccgagttatccacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaatagcactctgtttgtggaggtagcacgctgtttgtg

SEQ ID NO: 291832 - DNA, 468 bp, Homo sapiens
  misc_feature (133)..(133): n is a, c, g, or t
  misc_feature (135)..(136): n is a, c, g, or t
tgacacgttccacccgccacctccccctcaaaacactgatcgggcgacgatcgctgggccggcagtggagcccagccgtgccctgcctgagccagtccagttttaaaataaatagcaagcgttgccggtcttntnncccgaattctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291833 - DNA, 1600 bp, Homo sapiens
actcgattttgttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291834 - DNA, 1573 bp, Homo sapiens
  misc_feature (1568)..(1569): n is a, c, g, or t
actcgattttgttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaactgatacttttattaacatggtaagtttttgttgtnnagcc

SEQ ID NO: 291835 - DNA, 1480 bp, Homo sapiens
agcggatttgttcgccgttactctgcgcacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291836 - DNA, 1634 bp, Homo sapiens
accccaacgccgttccccggtttaaccttcctgccgccgttaaaagttcgcctttgttcccggtgggcctttcttcttgcaagaaaagaaaaccacgtttgcacccaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291837 - DNA, 1473 bp, Homo sapiens
taacgggaacgcgaccacgcgacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291838 - DNA, 1474 bp, Homo sapiens
tgggcggacgcgtgggctgcgcacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291839 - DNA, 1492 bp, Homo sapiens
cggacgcgtgggtcgacggacgcgtgggcgacccacgcgtacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291840 - DNA, 1533 bp, Homo sapiens
actcgattttgttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291841 - DNA, 1339 bp, Homo sapiens
actcgattttgttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaacttgtattgactttgaacatttttgacttggttcccatgcttgaaattctttattcatggttattatgtttttaccttgtgaaaataggttttctcttacatatttctcattacattttattcctgatactttaaattttaatccttggggtcctaataagtttgcctaattctctg

SEQ ID NO: 291842 - DNA, 1243 bp, Homo sapiens
tcagctcggtaccatctttgaatcatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291843 - DNA, 1471 bp, Homo sapiens
actcgattttgttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291844 - DNA, 1760 bp, Homo sapiens
  misc_feature (1755)..(1756): n is a, c, g, or t
actcgattttgttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactctcggagcattctggagaaagacctggtattgcatagtaattgctccgtaatggttggcgactgtaaggagcatggtgtgagacccatataggacggcagagatggcagtgcttgttcaaccagttccaaggtatttctcctggtactctattcgagtacatgcgccttgcctcttgctgagctgttgttctgaccaccttaaatcagcgtatgtatgacactgtaaccctgatatagatttgatacgatctagaatattcttgttacaagcttgattcttaatagccactgatcgcgctttgtacgaagcgatattggccatttagaatgaaaacgatcttgcaaatgcaccttgagggggcctaggggcgatagccatgtccataggacctgtactggcactggaccctcaagggcctttgccaatctttcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaactgatacttttattaacatggtaagtttttgttgtnnagcc

SEQ ID NO: 291845 - DNA, 1152 bp, Homo sapiens
aaatcgagctcggctacccatgcttcgatcgcgccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291846 - DNA, 1141 bp, Homo sapiens
cgatctagagctccccctatgtccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291847 - DNA, 1043 bp, Homo sapiens
actcgattttgttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgcctactttatatctacatagcgtgattgcgattgccggattactagggttacctcaaggt

SEQ ID NO: 291848 - DNA, 959 bp, Homo sapiens
cggacgcgtgggtcgacggacgcgtgggcgacccacgcgttctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291849 - DNA, 1558 bp, Homo sapiens
actcgattttgttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291850 - DNA, 1238 bp, Homo sapiens
  misc_feature (83)..(83): n is a, c, g, or t
  misc_feature (143)..(143): n is a, c, g, or t
ggccaacgaaagggtgattacacctccggaatccctccgcagccctctccgcctccgacgtcttggccagctgggaagatggnaaacttcttggagatggattatggtgatggctggaccacccatgagaaagtgaccttatnccctggattgcgataattaaaaatgggtaaactggccacgtttatgttataaataaatgtaccccccttaaaacccagtggaccttaaaattccctggaggagcccatatgggaaaaggactaaatgttgtaaaaaaaaaaagcccaccttttttttttaatccagagataagtacttagctgcaagctcaaggtctcgggtgaggacggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291851 - DNA, 829 bp, Homo sapiens
ctgatctagaggacccgagttatccacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291852 - DNA, 715 bp, Homo sapiens
gtgattctagcaggatccttaactgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291853 - DNA, 1212 bp, Homo sapiens
actcgattttgttcgccgttactctgcgcacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291854 - DNA, 1099 bp, Homo sapiens
actcgattttgttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaagggctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgttaaaacaaacaaaaacttaccatgttaataaaagtattcatttgcttgaaaagacgaaagacctaaaaaaaat

SEQ ID NO: 291855 - DNA, 764 bp, Homo sapiens
actcgattttgttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatccgccgatgactcacgacatgacggtcaatcttttcctgcttcccgagccg

SEQ ID NO: 291856 - DNA, 2363 bp, Homo sapiens
agcggaggctcgtccccggcggtcgcggccgcccgcgcgccggcggcccagcaacaggcgcaaagttgaggaaaggcccagccgccacgggccgccctcgacccgcccctgggccccgcctcctgcgagcggcggaggcggggccgcgcggttgccggagcgacgcgcagtgtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgagaatctgaagaataatcatccatccaaatttgaagatcctatattagttcctcttcaagaatttgcatggcatcaatatctacaggagaaaaaaagggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaagatgaaaacttttcagttcctcataataaaagaggagtacttggaatggccaacaaaggccgtcacagcaacgggtcacaattctatatcacactgcaagcaactccttatctagatagaaaatttgtggcttttgggcaactgattgaaggaacagaagtgcttaaacaactagaattagttccaacacagaatgaaagaccaatacatatgtgtagaattactgacagtggagatccttatgcttgattttcatatcaatattttctgtgataatttattactttgtatctgatcagctgtttgtggatttaattaaaaagtacttgataaattgtaatttgaaagccgtggcagacactgtaggttgcctcatctacacccaatccctccccatcttcctttcctgtctctgtcatagagactgtgaaagggtggtactcaatttcctagactcctttgcagccacgggtggccatgagagatggttctggccagtgggacaggaatagaacgccagtggtcctgccccttccccttcatccagtctggaatgtggagaggctggagctacagctgtcatcttgtggccataaagaaaaggctgaggccaggtgtggtagctcacgcctgtaatcccaaagtgctgagattacaaaggcgtgagccaccgcacccggctgagagtgcttttcttaccctaagcagaatgaggtttgtcttccaagaacaatctctatttacatcagtcttaaagaggcaggcttctaatggatatgaggcttgccaaaagtaggcgtaggcttttttaactttttattttgaaatatagattcacaggaagttgcaaaaatagtacagagcagtcctgtgtacctttcacccattttccccagtggctacgcttacaaaacggtagtacaatatcaaaccaggcagctgacattggtacaatgtgtgtgatgccattttatcatgagtatattcatgtaaccaacactatagagaaaatatagaacctttccagcacctcaaagacccccttccagtacccctttacagtcaacccactcccctgccctctgccatccctaactcctgacaactggcatttgcttttccttttaatgacagctttattgctatatgacatatgctttatgctaagacctgaggtggatgggaggaagcagaccgcctatgttacattctcaactgacccagagcaacatagtgttaagaatgtgtgttctagggccagaatcctggctttgccattccctagctgcacaaactcaggcaagaacttttctgtgcctcaattccttcatctgagaaacagtggtacctaccacataagattgctgtgagggttccatgaatcaataatttctataaagaacctataagagacctggtctgctgtaagcactcgataaatttaataataaattactaatgtgtaaccttca

SEQ ID NO: 291857 - DNA, 1967 bp, Homo sapiens
agcggaggctcgtccccggcggtcgcggccgcccgcgcgccggcggcccagcaacaggcgcaaagttgaggaaaggcccagccgccacgggccgccctcgacccgcccctgggccccgcctcctgcgagcggcggaggcggggccgcgcggttgccggagcgacgcgcagtgtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgagaatctgaagaataatcatccatccaaatttgaagatcctatattagttcctcttcaagaatttgcatggcatcaatatctacaggagaaaaaaagggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaagatgaaaacttttcagttcctcataataaaagaggagtacttggaatggccaacaaaggccgtcacagcaacgggtcacaattctatatcacactgcaagcaactccttatctagatagaaaatttgtggcttttgggcaactgattgaaggaacagaagtgcttaaacaactagaattagttccaacacagaatgaaagaccaatacatatgtgtagaattactgacagtggagatccttatgcttgattttcatatcaatattttctgtgataatttattactttgtatctgatcagctgtttgtggatttaattaaaaagtacttgataaattgtaatttgaaagccgtggcagacactgtaggttgcctcatctacacccaatccctccccatcttcctttcctgtctctgtcatagagactgtgaaagggtggtactcaatttcctagactcctttgcagccacgggtggccatgagagatggttctggccagtgggacaggaatagaacgccagtggtcctgccccttccccttcatccagtctggaatgtggagaggctggagctacagctgtcatcttgtggccataaagaaaaggctgaggccaggtgtggtagctcacgcctgtaatcccagcacttgggaggccgaggcaggtggatcacaagatcaagagattgagaccatcctggccaacatggtgaaaccctgtctctactaaaactacagaaattagctgggcatggtggcatgcacttgtagtcccagctacttgggaagctgaggcagaagaatctcttgaacccgggaggcggaggttgcagtgagccgagatgccgccactgcactccagcctggcgacagagagagactgtctcaaaaaaaaagaaaggccaagtactgcagagatgtcagccccagtctcttgagctgcgggaccaataccagcaaccacctactctggacttcttattataggagactaacagagccctgtgttgtgttgtttatgttactgttggttgagaattttgttacttgtggacaaaaaattcttaatttagcaacac

SEQ ID NO: 291858 - DNA, 2267 bp, Homo sapiens
agcggaggctcgtccccggcggtcgcggccgcccgcgcgccggcggcccagcaacaggcgcaaagttgaggaaaggcccagccgccacgggccgccctcgacccgcccctgggccccgcctcctgcgagcggcggaggcggggccgcgcggttgccggagcgacgcgcagtgtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgaggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaagatgaaaacttttcagttcctcataataaaagaggagtacttggaatggccaacaaaggccgtcacagcaacgggtcacaattctatatcacactgcaagcaactccttatctagatagaaaatttgtggcttttgggcaactgattgaaggaacagaagtgcttaaacaactagaattagttccaacacagaatgaaagaccaatacatatgtgtagaattactgacagtggagatccttatgcttgattttcatatcaatattttctgtgataatttattactttgtatctgatcagctgtttgtggatttaattaaaaagtacttgataaattgtaatttgaaagccgtggcagacactgtaggttgcctcatctacacccaatccctccccatcttcctttcctgtctctgtcatagagactgtgaaagggtggtactcaatttcctagactcctttgcagccacgggtggccatgagagatggttctggccagtgggacaggaatagaacgccagtggtcctgccccttccccttcatccagtctggaatgtggagaggctggagctacagctgtcatcttgtggccataaagaaaaggctgaggccaggtgtggtagctcacgcctgtaatcccaaagtgctgagattacaaaggcgtgagccaccgcacccggctgagagtgcttttcttaccctaagcagaatgaggtttgtcttccaagaacaatctctatttacatcagtcttaaagaggcaggcttctaatggatatgaggcttgccaaaagtaggcgtaggcttttttaactttttattttgaaatatagattcacaggaagttgcaaaaatagtacagagcagtcctgtgtacctttcacccattttccccagtggctacgcttacaaaacggtagtacaatatcaaaccaggcagctgacattggtacaatgtgtgtgatgccattttatcatgagtatattcatgtaaccaacactatagagaaaatatagaacctttccagcacctcaaagacccccttccagtacccctttacagtcaacccactcccctgccctctgccatccctaactcctgacaactggcatttgcttttccttttaatgacagctttattgctatatgacatatgctttatgctaagacctgaggtggatgggaggaagcagaccgcctatgttacattctcaactgacccagagcaacatagtgttaagaatgtgtgttctagggccagaatcctggctttgccattccctagctgcacaaactcaggcaagaacttttctgtgcctcaattccttcatctgagaaacagtggtacctaccacataagattgctgtgagggttccatgaatcaataatttctataaagaacctataagagacctggtctgctgtaagcactcgataaatttaataataaattactaatgtgtaaccttca

SEQ ID NO: 291859 - DNA, 1735 bp, Homo sapiens
agcggaggctcgtccccggcggtcgcggccgcccgcgcgccggcggcccagcaacaggcgcaaagttgaggaaaggcccagccgccacgggccgccctcgacccgcccctgggccccgcctcctgcgagcggcggaggcggggccgcgcggttgccggagcgacgcgcagtgtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgaggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaaggcaactgattgaaggaacagaagtgcttaaacaactagaattagttccaacacagaatgaaagaccaatacatatgtgtagaattactgacagtggagatccttatgcttgattttcatatcaatattttctgtgataatttattactttgtatctgatcagctgtttgtggatttaattaaaaagtacttgataaattgtaatttgaaagccgtggcagacactgtaggttgcctcatctacacccaatccctccccatcttcctttcctgtctctgtcatagagactgtgaaagggtggtactcaatttcctagactcctttgcagccacgggtggccatgagagatggttctggccagtgggacaggaatagaacgccagtggtcctgccccttccccttcatccagtctggaatgtggagaggctggagctacagctgtcatcttgtggccataaagaaaaggctgaggccaggtgtggtagctcacgcctgtaatcccagcacttgggaggccgaggcaggtggatcacaagatcaagagattgagaccatcctggccaacatggtgaaaccctgtctctactaaaactacagaaattagctgggcatggtggcatgcacttgtagtcccagctacttgggaagctgaggcagaagaatctcttgaacccgggaggcggaggttgcagtgagccgagatgccgccactgcactccagcctggcgacagagagagactgtctcaaaaaaaaagaaaggccaagtactgcagagatgtcagccccagtctcttgagctgcgggaccaataccagcaaccacctactctggacttcttattataggagactaacagagccctgtgttgtgttgtttatgttactgttggttgagaattttgttacttgtggacaaaaaattcttaatttagcaacac

SEQ ID NO: 291860 - DNA, 310 bp, Homo sapiens
ttcaggtcttgtgcacaggaaaagcagggttttctcaacgtggcataagactacattacaaaaattccatttttcatcgaatagtacagaatggctggatacaaggagggggtaagtttaaaatcttaaatacgagttaattgcaatatcaaatgagaaggtccaaactttcatttatctttatgaaatgtatgtagaattagatatacttaaaattagacgtatttaaagaatgctttatatagccaaataatgaagtaagatatttgtattctttaaaaaacaccctaattattaaaataaataaatc

SEQ ID NO: 291861 - DNA, 707 bp, Homo sapiens
agcggaggctcgtccccggcggtcgcggccgcccgcgcgccggcggcccagcaacaggcgcaaagttgaggaaaggcccagccgccacgggccgccctcgacccgcccctgggccccgcctcctgcgagcggcggaggcggggccgcgcggttgccggagcgacgcgcagtgtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgaggtaaccacagagaaacctccgtcgtgggcggccctcccggctacccgctctcggccgcgtggactgcaggcgccgcgcctcctcgaggcggcgggggtcgaggccccaccggccgaggaaggggctggcgtgtcctggccgggcgggctccgtctggaggaccgggaggagagtataggggggcaagtgcgggtccgggggcgggcgttccacttggcgacttttaaagggagaactgagcgaaggaagggttcagaaccgcgctgggagataaggtaatcccctccgagacacacacacacacacccgcagattttgttctacgtcaattttttctttaattagagatatttaaatttatggaaaaa

SEQ ID NO: 291862 - DNA, 2309 bp, Homo sapiens
agcggaggctcgtccccggcggtcgcggccgcccgcgcgccggcggcccagcaacaggcgcaaagttgaggaaaggcccagccgccacgggccgccctcgacccgcccctgggccccgcctcctgcgagcggcggaggcggggccgcgcggttgccggagcgacgcgcagtgtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgagaatctgaagaataatcatccatccaaatttgaagatcctatattagttcctcttcaagaatttgcatggcatcaatatctacaggagaaaaaaagggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaagatgaaaacttttcagttcctcataataaaagaggagtacttggaatggccaacaaaggccgtcacagcaacgggtcacaattctatatcacactgcaagcaactccttatctagatagaaaatttgtggcttttgggcaactgattgaaggaacagaagtgcttaaacaactagaattagttccaacacagaatgaaagaccaatacatatgtgtagaattactgacagtggagatccttatgcttgattttcatatcaatattttctgtgataatttattactttgtatctgatcagctgtttgtggatttaattaaaaagtacttgataaattgtaatttgaaagccgtggcagacactgtaggttgcctcatctacacccaatccctccccatcttcctttcctgtctctgtcatagagactgtgaaagggtggtactcaatttcctagactcctttgcagccacgggtggccatgagagatggttctggccagtgggacaggaatagaacgccagtggtcctgccccttccccttcatccagtctggaatgtggagaggctggagctacagctgtcatcttgtggccataaagaaaaggctgaggccaggtgtggtagctcacgcctgtaatcccaaagtgctgagattacaaaggcgtgagccaccgcacccggctgagagtgcttttcttaccctaagcagaatgaggtttgtcttccaagaacaatctctatttacatcagtcttaaagaggcaggcttctaatggatatgaggcttgccaaaagtaggcgtaggcttttttaactttttattttgaaatatagattcacaggaagttgcaaaaatagtacagagcagtcctgtgtacctttcacccattttccccagtggctacgcttacaaaacggtagtacaatatcaaaccaggcagctgacattggtacaatgtgtgtgatgccattttatcatgagtatattcatgtaaccaacactatagagaaaatatagaacctttccagcacctcaaagacccccttccagtacccctttacagtcaaccttttaatgacagctttattgctatatgacatatgctttatgctaagacctgaggtggatgggaggaagcagaccgcctatgttacattctcaactgacccagagcaacatagtgttaagaatgtgtgttctagggccagaatcctggctttgccattccctagctgcacaaactcaggcaagaacttttctgtgcctcaattccttcatctgagaaacagtggtacctaccacataagattgctgtgagggttccatgaatcaataatttctataaagaacctataagagacctggtctgctgtaagcactcgataaatttaataataaattactaatgtgtaaccttca

SEQ ID NO: 291863 - DNA, 1831 bp, Homo sapiens
agcggaggctcgtccccggcggtcgcggccgcccgcgcgccggcggcccagcaacaggcgcaaagttgaggaaaggcccagccgccacgggccgccctcgacccgcccctgggccccgcctcctgcgagcggcggaggcggggccgcgcggttgccggagcgacgcgcagtgtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgagaatctgaagaataatcatccatccaaatttgaagatcctatattagttcctcttcaagaatttgcatggcatcaatatctacaggagaaaaaaagggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaaggcaactgattgaaggaacagaagtgcttaaacaactagaattagttccaacacagaatgaaagaccaatacatatgtgtagaattactgacagtggagatccttatgcttgattttcatatcaatattttctgtgataatttattactttgtatctgatcagctgtttgtggatttaattaaaaagtacttgataaattgtaatttgaaagccgtggcagacactgtaggttgcctcatctacacccaatccctccccatcttcctttcctgtctctgtcatagagactgtgaaagggtggtactcaatttcctagactcctttgcagccacgggtggccatgagagatggttctggccagtgggacaggaatagaacgccagtggtcctgccccttccccttcatccagtctggaatgtggagaggctggagctacagctgtcatcttgtggccataaagaaaaggctgaggccaggtgtggtagctcacgcctgtaatcccagcacttgggaggccgaggcaggtggatcacaagatcaagagattgagaccatcctggccaacatggtgaaaccctgtctctactaaaactacagaaattagctgggcatggtggcatgcacttgtagtcccagctacttgggaagctgaggcagaagaatctcttgaacccgggaggcggaggttgcagtgagccgagatgccgccactgcactccagcctggcgacagagagagactgtctcaaaaaaaaagaaaggccaagtactgcagagatgtcagccccagtctcttgagctgcgggaccaataccagcaaccacctactctggacttcttattataggagactaacagagccctgtgttgtgttgtttatgttactgttggttgagaattttgttacttgtggacaaaaaattcttaatttagcaacac

SEQ ID NO: 291864 - DNA, 1630 bp, Homo sapiens
agcggaggctcgtccccggcggtcgcggccgcccgcgcgccggcggcccagcaacaggcgcaaagttgaggaaaggcccagccgccacgggccgccctcgacccgcccctgggccccgcctcctgcgagcggcggaggcggggccgcgcggttgccggagcgacgcgcagtgtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgaggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaaggcaactgattgaaggaacagaagtgcttaaacaactagaattagttccaacacagaatgaaagaccaatacatatgtgtagaattactgacagtggagatccttatgcttgattttcatatcaatattttctgtgataatttattactttgtatctgatcagctgtttgtggatttaattaaaaagtacttgataaattgtaatttgaaagccgtggcagacactgtaggttgcctcatctacacccaatccctccccatcttcctttcctgtctctgtcatagagactgtgaaagggtggtactcaatttcctagactcctttgcagccacgggtggccatgagagatggttctggccagtgggacaggaatagaacgccagtggtcctgccccttccccttcatccagtctggaatgtggagaggctggagctacagctgtcatcttgtggccataaagaaaaggctgaggccaggtgtggtagctcacgcctgtaatcccagcacttgggaggccgaggcaggtggatcacaagatcaagagattgagaccatcctggccaacatggtgaaaccctgtctctactaaaactacagaaattagctgggcatggtggcatgcacttgtagtcccagctacttgggaagctgaggcagaagaatctcttgaacccgggaggcggaggttgcagtgagccgagatgccgccactgcactccagcctggcgacagagagagactgtctcaaaaaaaaagaaaggccaagtactgcagagatgtcagccccagtctcttgagctgcgggaccaataccagcaaccacctactctggacttcttattataggagactaacagagccctgtgttgtgttgtttatgttactgttggttgagaattttgttacttgtggacaaaaaattcttaatttagcaacac

SEQ ID NO: 291865 - DNA, 2795 bp, Homo sapiens
ggagcggagcaggaaggggcgaggcagccccgcccccggggcggtctcccgggacggccccgccccttgcccgcttccgcgtcagtgcctcaccaccacctgcccgcgcgccgccccatataaaggcgccgccgtccttgcccccaggactcggccccatggagacgccgccggccgccgctggcgcatggcgggtaggagctgtggcgcggggccttccaggagtctgagctatgagtggcccctgtggagagaagcctgtcctggaagccagccccaccatgagtctgtgggaatttgaggacagccacagccgtcagggcaccccaaggccgggtcaagagctggccgctgaggaggcctcggccctggaactgcagatgaaggtggacttcttccggaagctgggctattcatccacggagatccacagcgtcctgcagaagctgggcgtccaggcagacaccaacacggtgctgggtgagctggtgaaacacgggacagccaccgagcgggagcgccagacctcaccggacccctgccctcagctccctctagtcccgcggggtggtggcacccctaaggctcccaacctggagcctccactcccagaagaggaaaaggagggcagcgacctgagaccagtggtcatcgatgggagcaacgtggccatgagccatgggaacaaggaggtcttctcctgccggggcatcctgctggcagtgaactggtttctggagcggggccacacagacatcacagtgtttgtgccatcctggaggaaggagcagcctcggcccgacgtgcccatcacagaccagcacatcctgcgggaactggagaagaagaagatcctggtgttcacaccatcacgacgcgtgggtggcaagcgggtggtgtgctatgacgacagattcattgtgaagctggcctacgagtctgacgggatcgtggtttccaacgacacataccgtgacctccaaggcgagcggcaggagtggaagcgcttcatcgaggagcggctgctcatgtactccttcgtcaatgacaagtttatgccccctgatgacccactgggccggcacgggcccagcctggacaacttcctgcgtaagaagccactcactttggagcacaggaagcagccgtgtccctatggaaggaaatgcacctatgggatcaagtgccgattcttccacccagagcggccaagctgcccccagcgctctgtggcagatgagctccgtgccaatgctctcctctcaccccccagagccccaagcaaggacaaaaatggccggcggccttcaccttcatcccagtccagctctctgctaacagagagtgagcagtgcagcctggatgggaagaagctgggggcccaggcatccccagggtcccgccaagagggtctaacacagacctatgccccatcaggcaggagcctcgcacctagcgggggcagtggcagcagctttgggcccacagactggctcccacagacgctggactcactcccgtacgtctcccaggattgcctggactcgggcattggctccctggagagccagatgtcggaactttggggggttcgaggaggaggccctggtgagccgggcccaccccgagccccttacacgggctacagtccctatggatctgagctcccagccaccgcagccttctctgcctttggccgggccatgggtgctggccacttcagtgtccctgccgactacccacccgcgccccctgcctttccacctcgagagtactggtctgaaccatacccactgcccccacccacatcagtccttcaggagcccccagtgcagagcccaggggctggcaggagcccgtggggcagggcaggcagcctggccaaggagcaggccagcgtgtatactaagctgtgtggtgtgtttcccccgcacctggtggaggctgtgatggggcgcttcccacagctcctggacccccagcagctggctgccgagatcctctcctacaagtcccagcaccccagtgagtaagctgcctgtggctggcaagggcagcacccccagcctccaagggccgtcaggctgggctttgggccattgagcagcccattcccagccctgaggcccaccccagaggctggacagagggaggattcaagtcgggaaggaaacccacaaaccaaagatactgtaggattggttctggcccatgcagcacctctagctgtctgcctcagtgggtcagaagcgatcaccctgttgatacacattgtatctctgtagtttaaggagacgctgccggtaacggcgtcggtccgtggctgaggcccaaaccgtcttttctctcagagggtggggagggaggtgggggcagcagaggcctgggctgggtgccctgtgcacgccaccccacttccgccctacccctgggacgttggccttggctggctagttgggcaccgtgtgcctgccctccaagggcctcctctacgccaatgaggcctcatctgtgctctcgctgggcacgtggcttcatgtcagtaagcaagatgcttcttaataacccaccttctgccccactctattccttatcctgctgcccctgtaggggtcaagggccctccgtctacaccctcttcttctcctccatcctttattcagagtcatctcgcccttccccatgggtgggggaacctgtgtttgtttgtgtgcacatgtaaattttaaatattttaagcagaaagtccttacctcctgtaacacatcaataaagtacaatcattgtgagccctt

SEQ ID NO: 291866 - DNA, 641 bp, Homo sapiens
  misc_feature (351)..(351): n is a, c, g, or t
ggagcggagcaggaaggggcgaggcagccccgcccccggggcggtctcccgggacggccccgccccttgcccgcttccgcgtcagtgcctcaccaccacctgcccgcgcgccgccccatataaaggcgccgccgtccttgcccccaggactcggccccatggagacgccgccggccgccgctggcgcatggcggggtgaggcgcggcggggagggtgcgggcctcggcggggaagcggcagggagcgctccggcggggtccgagccgagccgaggggaggggacgggaggggacgggaggggtggagaattatggtgtttatataaaaaaaaaaaattttttaaaaacttncatcttaagtaatagcttctctatacttactccataccccaaaatcaataaataagcatttagaaaacgttgaagttttaaagattgcctcctcctaccaaaacccttctgtcttaaataatgtgtttctttttgcctacaccagctttcaaaaacctcttagtcctatgttggaaagtaatcaatgttgaaccctgtgagtagttatttacagtatgaattctcattctttcgtttaaaaataattaattgatttatttcaaattttcacctatatctcttaattctat

SEQ ID NO: 291867 - DNA, 192 bp, Homo sapiens
  misc_feature (8)..(8): n is a, c, g, or t
  misc_feature (17)..(17): n is a, c, g, or t
  misc_feature (62)..(62): n is a, c, g, or t
atcttttnccgtctttncccaccaaaattaccccccctttttttttttaaaatttcaagagntcatctcgcccttccccatgggtgggggaacctgtgtttgtttgtgtgcacatgtaaattttaaatattttaagcagaaagtccttacctcctgtaacacatcaataaagtacaatcattgtgagccctt

SEQ ID NO: 291868 - DNA, 2852 bp, Homo sapiens
agttccgatcttcgagccaccagctaacagctggatgaccttgagcacgtttttaatgtctgtgcctcagtttctccctttatagaatgggaatgggaatgcctagctgggagagcttttgagaggacaacctgaactaataacacgatgcagtgtgtagtgccaccaatccctcatcctgctggatgtggttttgggagggaggttaggagagagcgctattcaccgtccctaaccctgttggttgttcagtaggagctgtggcgcggggccttccaggagtctgagctatgagtggcccctgtggagagaagcctgtcctggaagccagccccaccatgagtctgtgggaatttgaggacagccacagccgtcagggcaccccaaggccgggtcaagagctggccgctgaggaggcctcggccctggaactgcagatgaaggtggacttcttccggaagctgggctattcatccacggagatccacagcgtcctgcagaagctgggcgtccaggcagacaccaacacggtgctgggtgagctggtgaaacacgggacagccaccgagcgggagcgccagacctcaccggacccctgccctcagctccctctagtcccgcggggtggtggcacccctaaggctcccaacctggagcctccactcccagaagaggaaaaggagggcagcgacctgagaccagtggtcatcgatgggagcaacgtggccatgagccatgggaacaaggaggtcttctcctgccggggcatcctgctggcagtgaactggtttctggagcggggccacacagacatcacagtgtttgtgccatcctggaggaaggagcagcctcggcccgacgtgcccatcacagaccagcacatcctgcgggaactggagaagaagaagatcctggtgttcacaccatcacgacgcgtgggtggcaagcgggtggtgtgctatgacgacagattcattgtgaagctggcctacgagtctgacgggatcgtggtttccaacgacacataccgtgacctccaaggcgagcggcaggagtggaagcgcttcatcgaggagcggctgctcatgtactccttcgtcaatgacaagtttatgccccctgatgacccactgggccggcacgggcccagcctggacaacttcctgcgtaagaagccactcactttggagcacaggaagcagccgtgtccctatggaaggaaatgcacctatgggatcaagtgccgattcttccacccagagcggccaagctgcccccagcgctctgtggcagatgagctccgtgccaatgctctcctctcaccccccagagccccaagcaaggacaaaaatggccggcggccttcaccttcatcccagtccagctctctgctaacagagagtgagcagtgcagcctggatgggaagaagctgggggcccaggcatccccagggtcccgccaagagggtctaacacagacctatgccccatcaggcaggagcctcgcacctagcgggggcagtggcagcagctttgggcccacagactggctcccacagacgctggactcactcccgtacgtctcccaggattgcctggactcgggcattggctccctggagagccagatgtcggaactttggggggttcgaggaggaggccctggtgagccgggcccaccccgagccccttacacgggctacagtccctatggatctgagctcccagccaccgcagccttctctgcctttggccgggccatgggtgctggccacttcagtgtccctgccgactacccacccgcgccccctgcctttccacctcgagagtactggtctgaaccatacccactgcccccacccacatcagtccttcaggagcccccagtgcagagcccaggggctggcaggagcccgtggggcagggcaggcagcctggccaaggagcaggccagcgtgtatactaagctgtgtggtgtgtttcccccgcacctggtggaggctgtgatggggcgcttcccacagctcctggacccccagcagctggctgccgagatcctctcctacaagtcccagcaccccagtgagtaagctgcctgtggctggcaagggcagcacccccagcctccaagggccgtcaggctgggctttgggccattgagcagcccattcccagccctgaggcccaccccagaggctggacagagggaggattcaagtcgggaaggaaacccacaaaccaaagatactgtaggattggttctggcccatgcagcacctctagctgtctgcctcagtgggtcagaagcgatcaccctgttgatacacattgtatctctgtagtttaaggagacgctgccggtaacggcgtcggtccgtggctgaggcccaaaccgtcttttctctcagagggtggggagggaggtgggggcagcagaggcctgggctgggtgccctgtgcacgccaccccacttccgccctacccctgggacgttggccttggctggctagttgggcaccgtgtgcctgccctccaagggcctcctctacgccaatgaggcctcatctgtgctctcgctgggcacgtggcttcatgtcagtaagcaagatgcttcttaataacccaccttctgccccactctattccttatcctgctgcccctgtaggggtcaagggccctccgtctacaccctcttcttctcctccatcctttattcagagtcatctcgcccttccccatgggtgggggaacctgtgtttgtttgtgtgcacatgtaaattttaaatattttaagcagaaagtccttacctcctgtaacacatcaataaagtacaatcattgtgagccctt

SEQ ID NO: 291869 - DNA, 2326 bp, Homo sapiens
aggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgatccctacgccacctttgtcaagatgctgccagataaggactgccgctatgccctctatgatgcaaccatgggaacaaggaggtcttctcctgccggggcatcctgctggcagtgaactggtttctggagcggggccacacagacatcacagtgtttgtgccatcctggaggaaggagcagcctcggcccgacgtgcccatcacagaccagcacatcctgcgggaactggagaagaagaagatcctggtgttcacaccatcacgacgcgtgggtggcaagcgggtggtgtgctatgacgacagattcattgtgaagctggcctacgagtctgacgggatcgtggtttccaacgacacataccgtgacctccaaggcgagcggcaggagtggaagcgcttcatcgaggagcggctgctcatgtactccttcgtcaatgacaagtttatgccccctgatgacccactgggccggcacgggcccagcctggacaacttcctgcgtaagaagccactcactttggagcacaggaagcagccgtgtccctatggaaggaaatgcacctatgggatcaagtgccgattcttccacccagagcggccaagctgcccccagcgctctgtggcagatgagctccgtgccaatgctctcctctcaccccccagagccccaagcaaggacaaaaatggccggcggccttcaccttcatcccagtccagctctctgctaacagagagtgagcagtgcagcctggatgggaagaagctgggggcccaggcatccccagggtcccgccaagagggtctaacacagacctatgccccatcaggcaggagcctcgcacctagcgggggcagtggcagcagctttgggcccacagactggctcccacagacgctggactcactcccgtacgtctcccaggattgcctggactcgggcattggctccctggagagccagatgtcggaactttggggggttcgaggaggaggccctggtgagccgggcccaccccgagccccttacacgggctacagtccctatggatctgagctcccagccaccgcagccttctctgcctttggccgggccatgggtgctggccacttcagtgtccctgccgactacccacccgcgccccctgcctttccacctcgagagtactggtctgaaccatacccactgcccccacccacatcagtccttcaggagcccccagtgcagagcccaggggctggcaggagcccgtggggcagggcaggcagcctggccaaggagcaggccagcgtgtatactaagctgtgtggtgtgtttcccccgcacctggtggaggctgtgatggggcgcttcccacagctcctggacccccagcagctggctgccgagatcctctcctacaagtcccagcaccccagtgagtaagctgcctgtggctggcaagggcagcacccccagcctccaagggccgtcaggctgggctttgggccattgagcagcccattcccagccctgaggcccaccccagaggctggacagagggaggattcaagtcgggaaggaaacccacaaaccaaagatactgtaggattggttctggcccatgcagcacctctagctgtctgcctcagtgggtcagaagcgatcaccctgttgatacacattgtatctctgtagtttaaggagacgctgccggtaacggcgtcggtccgtggctgaggcccaaaccgtcttttctctcagagggtggggagggaggtgggggcagcagaggcctgggctgggtgccctgtgcacgccaccccacttccgccctacccctgggacgttggccttggctggctagttgggcaccgtgtgcctgccctccaagggcctcctctacgccaatgaggcctcatctgtgctctcgctgggcacgtggcttcatgtcagtaagcaagatgcttcttaataacccaccttctgccccactctattccttatcctgctgcccctgtaggggtcaagggccctccgtctacaccctcttcttctcctccatcctttattcagagtcatctcgcccttccccatgggtgggggaacctgtgtttgtttgtgtgcacatgtaaattttaaatattttaagcagaaagtccttacctcctgtaacacatcaataaagtacaatcattgtgagccctt

SEQ ID NO: 291870 - DNA, 2274 bp, Homo sapiens
gggtggagctgggggctgggctctgcggggccctgtggccatgggaggttgcgggtcttggctccaggcagctttgagagtgagacggatagctcaccacataggagaaatcagaccgggaccaggcaggctgtggggtggagagagtggctaatttgggagatagagccgtagcacttatgaggggatgtatgtggttgatggttccaggtggcctctctacgaaccaacatggcatctctcgagcagaggccatgggccagtgggtgcgggctgccatcccccgacgacctcagagagggagttcccctaaaggtgcccatgggctgtggccctctagaccggggatccctttctcctcccttggtatgatcccacccatagagcagttttgcggggtcctggacaggccccagttttaggtgtcactctcctattcttcccagcaaggcttgccatcggccccttctcagcaattagaagtccctgcatggctcccacctccagagagttctttgcaccctctgcaggtttatgccccctgatgacccactgggccggcacgggcccagcctggacaacttcctgcgtaagaagccactcactttggagcacaggaagcagccgtgtccctatggaaggaaatgcacctatgggatcaagtgccgattcttccacccagagcggccaagctgcccccagcgctctgtggcagatgagctccgtgccaatgctctcctctcaccccccagagccccaagcaaggacaaaaatggccggcggccttcaccttcatcccagtccagctctctgctaacagagagtgagcagtgcagcctggatgggaagaagctgggggcccaggcatccccagggtcccgccaagagggtctaacacagacctatgccccatcaggcaggagcctcgcacctagcgggggcagtggcagcagctttgggcccacagactggctcccacagacgctggactcactcccgtacgtctcccaggattgcctggactcgggcattggctccctggagagccagatgtcggaactttggggggttcgaggaggaggccctggtgagccgggcccaccccgagccccttacacgggctacagtccctatggatctgagctcccagccaccgcagccttctctgcctttggccgggccatgggtgctggccacttcagtgtccctgccgactacccacccgcgccccctgcctttccacctcgagagtactggtctgaaccatacccactgcccccacccacatcagtccttcaggagcccccagtgcagagcccaggggctggcaggagcccgtggggcagggcaggcagcctggccaaggagcaggccagcgtgtatactaagctgtgtggtgtgtttcccccgcacctggtggaggctgtgatggggcgcttcccacagctcctggacccccagcagctggctgccgagatcctctcctacaagtcccagcaccccagtgagtaagctgcctgtggctggcaagggcagcacccccagcctccaagggccgtcaggctgggctttgggccattgagcagcccattcccagccctgaggcccaccccagaggctggacagagggaggattcaagtcgggaaggaaacccacaaaccaaagatactgtaggattggttctggcccatgcagcacctctagctgtctgcctcagtgggtcagaagcgatcaccctgttgatacacattgtatctctgtagtttaaggagacgctgccggtaacggcgtcggtccgtggctgaggcccaaaccgtcttttctctcagagggtggggagggaggtgggggcagcagaggcctgggctgggtgccctgtgcacgccaccccacttccgccctacccctgggacgttggccttggctggctagttgggcaccgtgtgcctgccctccaagggcctcctctacgccaatgaggcctcatctgtgctctcgctgggcacgtggcttcatgtcagtaagcaagatgcttcttaataacccaccttctgccccactctattccttatcctgctgcccctgtaggggtcaagggccctccgtctacaccctcttcttctcctccatcctttattcagagtcatctcgcccttccccatgggtgggggaacctgtgtttgtttgtgtgcacatgtaaattttaaatattttaagcagaaagtccttacctcctgtaacacatcaataaagtacaatcattgtgagccctt

SEQ ID NO: 291871 - DNA, 1217 bp, Homo sapiens
ggagcggagcaggaaggggcgaggcagccccgcccccggggcggtctcccgggacggccccgccccttgcccgcttccgcgtcagtgcctcaccaccacctgcccgcgcgccgccccatataaaggcgccgccgtccttgcccccaggactcggccccatggagacgccgccggccgccgctggcgcatggcgggtaggagctgtggcgcggggccttccaggagtctgagctatgagtggcccctgtggagagaagcctgtcctggaagccagccccaccatgagtctgtgggaatttgaggacagccacagccgtcagggcaccccaaggccgggtcaagagctggccgctgaggaggcctcggccctggaactgcagatgaaggtggacttcttccggaagctgggctattcatccacggagatccacagcgtcctgcagaagctgggcgtccaggcagacaccaacacggtgctgggtgagctggtgaaacacgggacagccaccgagcgggagcgccagacctcaccggacccctgccctcagctccctctagtcccgcggggtggtggcacccctaaggctcccaacctggagcctccactcccagaagaggaaaaggagggcagcgacctgagaccagtggtcatcgatgggagcaacgtggccatgagccatgggaacaaggaggtcttctcctgccggggcatcctgctggcagtgaactggtttctggagcggggccacacagacatcacagtgtttgtgccatcctggaggaaggagcagcctcggcccgacgtgcccatcacagaccagcacatcctgcgggaactggagaagaagaagatcctggtgttcacaccatcacgacgcgtgggtggcaagcgggtggtgtgctatgacgacagattcattgtgaagctggcctacgagtctgacgggatcgtggcttcatgtcagtaagcaagatgcttcttaataacccaccttctgccccactctattccttatcctgctgcccctgtaggggtcaagggccctccgtctacaccctcttcttctcctccatcctttattcagagtcatctcgcccttccccatgggtgggggaacctgtgtttgtttgtgtgcacatgtaaattttaaatattttaagcagaaagtccttacctcctgtaacacatcaataaagtacaatcattgtgagccctt

SEQ ID NO: 291872 - DNA, 1300 bp, Homo sapiens
ggagcggagcaggaaggggcgaggcagccccgcccccggggcggtctcccgggacggccccgccccttgcccgcttccgcgtcagtgcctcaccaccacctgcccgcgcgccgccccatataaaggcgccgccgtccttgcccccaggactcggccccatggagacgccgccggccgccgctggcgcatggcgggtaggagctgtggcgcggggccttccaggagtctgagctatgagtggcccctgtggagagaagcctgtcctggaagccagccccaccatgagtctgtgggaatttgaggacagccacagccgtcagggcaccccaaggccgggtcaagagctggccgctgaggaggcctcggccctggaactgcagatgaaggtggacttcttccggaagctgggctattcatccacggagatccacagcgtcctgcagaagctgggcgtccaggcagacaccaacacggtgctgggtgagctggtgaaacacgggacagccaccgagcgggagcgccagacctcaccggacccctgccctcagctccctctagtcccgcggggtggtggcacccctaaggctcccaacctggagcctccactcccagaagaggaaaaggagggcagcgacctgagaccagtggtcatcgatgggagcaacgtggccatgagccatgggaacaaggaggtcttctcctgccggggcatcctgctggcagtgaactggtttctggagcggggccacacagacatcacagtgtttgtgccatcctggaggaaggagcagcctcggcccgacgtgcccatcacagaccagcacatcctgcgggaactggagaagaagaagatcctggtgttcacaccatcacgacgcgtgggtggcaagcgggtggtgtgctatgacgacagattcattgtgaagctggcctacgagtctgacgggatcgtggtttccaacgacacataccgtgacctccaaggcgagcggcaggagtggaagcgcttcatcgaggagcggctgctcatgtactccttcgtcaatgacaagcttgccatcggccccttctcagcaattagaagtccctgcatggctcccacctccagagagttctttgcaccctctgcaggtttatgccccctgatgacccactgggccggcacgggcccagcctggacaacttcctgcgtaagaagccactcactttggagcacaggaagcagccgtgtccctatggtatggaacccagcctgccctccccggccctcctcactcctgcccttcctctcacctgtctg

SEQ ID NO: 291873 - DNA, 252 bp, Homo sapiens
ctgccgcctgtgttcagatgttcttggtcttcaggcagcaaactgtgccacgccaagggaggggctggggcatggaagaggcctcagcagagttagttcttgccccggtgaccttggcgttaaccactcctgtgtgtggccatcagcaggttagggagccctgtaggcctggctctaggtcccgctgggccctgacctgtgtgcacccgtcacctcccagaccagcacatcctgcgggaactggagaagaag

SEQ ID NO: 291874 - DNA, 1195 bp, Homo sapiens
tattttataattgtgggtggcatgctgcaaagccttgcagattgttatttcttacaacctgagcgtatatagtatgagcctaagaaaaaagaagagtaagaaaagaagaatggctttacagtaaaatatcatacaatgcagacaatattttaagaggatattggagattatgtacgcaagggccaagaaagcaagaaatgagaaccagagtcagccctgtagctttacttcagtgcttccattctagatgatgctgatattataaagagttagtcactgctgctaagcatggaggactatatacataagctcgtttatacagtgtttgcttgtgggagggtttaatccttttagggccttgatgtcaagaaaaaaataactggaaactatattttgctaaagatagaaatgaggaactgtgtcattttgggacatgtgcaaatcattgaggaactccatcaccctgcattgaaaattgatttttttttcctctaaaatgagaaagaaactgaataagcaatctgttgcctctttactcattcatcacaatatcctgattcgtcataaggctatcagtatataagggctagaaaataatcatagcttaaattaattttttcattgattttattgatcagtgcattgaacagtgtttattattcacaagttgtcttttattagtaaatcaaggcctcatagcacattgttaaataaagtggttgactagtctatgtaacagctcaccaagctactatctcttttaactccttataatgttgcgtcattaaaggtcaaggggtcatgctattaatctcattgctatagaccattaacatgactgaacttttccacaaagtacttatgtttacaatgctataaccctttgactgctgcggcaacctttaaccacacaaatgtcacaagctagaatcatcagcatggttcttgccatggcaatcaaagagttaagggctgtgcagtgatttgttttgtatttattaatttatatttattttgtttccattcaaggaggggattaggggtggggcagtttttgtctgctgtaagtgtcttaacctagggaagggttaaatggctttttatactattgcatcttctgtatttaccatcaattcattgtgttgtaattaaaagaaactgtcaataaataagagaacagaaaaatggttcatag

SEQ ID NO: 291875 - DNA, 1779 bp, Homo sapiens
tattttataattgtgggtggcatgctgcaaagccttgcagattgttatttcttacaacctgagcgtatatagtatgagcctaagaaaaaagaagagtaagaaaagaagaatggctttacagtaaaatatcatacaatgcagacaatattttaagaggatattggagattatgtacgcaagggccaagaaagcaagaaatgagaaccagagtcagccctgtagctttacttcagtgcttccattctagatgatgctgatattataaagagttagtcactgctgctaagcatggaggactatatacataagctcgtttatacagtgtttgcttgtgggagggtttaatccttttagggccttgatgtcaagaaaaaaataactggaaactatattttgctaaagatagaaatgaggaactgtgtcattttgggacatgtgcaaatcattgaggaactccatcaccctgcattgaaaattgatttttttttcctctaaaatgagaaagaaactgaataagcaatctgttgcctctttactcattcatcacaatatcctgattcgtcataaggctatcagtatataagggctagaaaataatcatagcattaagaaggaaggagtctatcattatgcttgaattctggcaaatgtcatgaataagggttgggtcatatttactttaatatgagacaagatttatgtgataagcaaaggcatataaggctgctcttttgaacagaacatttcagttatcaggctgtactattacaagagataagaagacaataaggacaatgtaatcacaaacagtgggattccatttgtttattgtacaccagctactttgtgggtatggttcctgactcctcttctacatgaggtttgggaaaaaagtctcaaaccaaatggaacagtgaaagggaaagtaattcatctagcacataagaatagtgattcaaaaccaatgcagaataaatttccatgggtcaataacataaggtgtcagttcagtgttactagagatatgcaaggcataaaatattttcatcaccccatcactaataacatgaaaagctcagacataggatttcccaaattgaaatgaaaacacattcatgcctgcaaaaataattctccttctgcttcatttctcattactttatctaatataaacacaaatgtaaacaaggtaatggtcttcatgtaaaatgaccatatagttaagaattttagtaaaatattgttgttctgtgtattattaaacaaatgcaatgaagtattaaaatagctgatcagtttgaatttcctgtaaagcagtaattccgcatcagaattgtagataaggttgtgaatttattgactcatttcagaacagtgtctgttgacatggcagtcagagcaggtgaatacagatgctctttctgattgcaaaggttatagagctaaattagacagcattatgtgatactagcaaagacaacttctgttataaatcagagggcaaggcttttctgaatcgatgtgataaattactaagtaatgattaccaaaaataattactaagtaataaaagatacagactggtttactgaaataagcaagtgttacatttaataattacctataatctttttttgttaacacataagcaagtgttacctttaataattacctataatctttttttgttaacacataatttggccatttcatatactgtgtacctattttcattccctctctgtgggtcattaaaaaacacaatgtggtggataagaa

SEQ ID NO: 291876 - DNA, 2562 bp, Homo sapiens
cattgcctgagtaaaattaggtttttaggtctttttggcatttacttcttttacagctgatgtggaatcaattattcctttatatgttcataagtacaaaatttcactatcttaattacttccaaacaaacaatttccaagcaagggtatgtgtgcctggtttttctgctcctccaattctaagatcgttatttgtttgccttctgtttctcacccaaaaatacagatggttgggaaagatacatcttattgagttgtcctatgcagtctctgtctatatttgcatttctttctattcctatcttgcctttttttttttttttacacagatttggttttcccttccctttgtgaaaaccagaattgagcagcattgtacatcagagatggtacccaggaaatgtctttgttcctcagtatttttcgtcaaaacttccatgcaaagacagtcccagcaaagttgacatacatcccaacctctctcattggcttttctaactttttatagagctattcccctgagaaaagtgaaatgctgagtatgatgggtattgcctgttgataggatagctaaggaaatttgcttttggagaatgtatcttaaataattatacaggaaagtagtcacagtatagtgttctgtttaaggtacatcatgggtacataaatgtctaaaaccttcatcctttggtctatttctctgtaagtgtaaattacatatatattagaaagagagatagaatcaaagaattaggggtgttacagaggcagctttttgctgccttggttttgactgtatcagcatttctattgcagacctctattttcaggggttttagagactcgaccataaaaatttgtttcaggcttaaaagttttgaaagatttttttaggtatctgattttaaacaaatagatcttgtttttatattataggagggaaataaatggagtttactagttcaattttgcgctaatataacttttaataaacttaactttttaaacaaaaacataaaatctaattagttcatagttggttgatgcttttttaaaagaatcaattattgaccttgagaaacttgcctgcttcatcagtatagtaacctatctttgagatattttaaaacgtgtatacctttattaacattatcttgattccagcggtggatcagtatgataatgcagatttatgacatccatataagctatctggtaatatagatttaggaatatatagtatatatgatacatatatatatatatatatttactagatagattaaggagaaaaagctcccataaacttagtttgtcaaataaataccatatatttaaaaaatgcacagacatttatcattcagagtcagaatgagattcaagtaattgcaaagggaagttgtctcttgggtaaacaatacacattttatagcttcttgtgaaactaattttttcctttctatattgtggttatgggaaagtaaaagaattaaaattaatacagactttatttaaataacattaaactgtgaagcagagagaaacgccaggaaattaaatatttaggccattatcttgtggttgtctgacaatacttcacctttcttttaattccccatgatgttttcaattatggagagagtattaaaatctagatttaagtttctgcattgttctcattacactcaacactatttcattaagttcttgataatatgtagtcttctgtgtgcaaggaaagaaataaataacacatttatttgctgaatgagttttaaggtgtgcaagttgtagtgatgtttttcccacacaggattctatacacttataccatcttaaatctggcatttttttttcagatagcttctactgacaaacacaaagcttgtttgtgtgcaaatataaggctaaataaatggtgctaaagtgtattatgactgtcagataaaatcaggcaaaattttgtggtgcttaaattaattttttcattgattttattgatcagtgcattgaacagtgtttattattcacaagttgtcttttattagtaaatcaaggcctcatagcacattgttaaataaagtggttgactagtctatgtaacagctcaccaagctactatctcttttaactccttataatgttgcgtcattaaaggtcaaggggtcatgctattaatctcattgctatagaccattaacatgactgaacttttccacaaagtacttatgtttacaatgctataaccctttgactgctgcggcaacctttaaccacacaaatgtcacaagctagaatcatcagcatggttcttgccatggcaatcaaagagttaagggctgtgcagtgatttgttttgtatttattaatttatatttattttgtttccattcaaggaggggattaggggtggggcagtttttgtctgctgtaagtgtcttaacctagggaagggttaaatggctttttatactattgcatcttctgtatttaccatcaattcattgtgttgtaattaaaagaaactgtcaataaataagagaacagaaaaatggttcatag

SEQ ID NO: 291877 - DNA, 4921 bp, Homo sapiens
ctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtcatggcagcgccaggcggcaggtcggagccgccgcagctccccgagtacagctgcagctacatggtgtcgcggccggtctacagcgagctcgctttccagcaacagcacgagcggcgcctgcaggagcgcaagacgctgcgggagagcctggccaagtgctgcagttgttcaagaaagagagcctttggtgtgctaaagactcttgtgcccatcttggagtggctccccaaataccgagtcaaggaatggctgcttagtgacgtcatttcgggagttagtactgggctagtggccacgctgcaagggatggcatatgccctactagctgcagttcctgtcggatatggtctctactctgcttttttccctatcctgacatactttatctttggaacatcaagacatatctcagttggaccttttccagtggtgagtttaatggtgggatctgttgttctgagcatggcccccgacgaacactttctcgtatccagcagcaatggaactgtattaaatactactatgatagacactgcagctagagatacagctagagtcctgattgccagtgccctgactctgctggttggaattatacagttgatatttggtggcttgcagattggattcatagtgaggtacttggcagatcctttggttggtggcttcacaacagctgctgccttccaagtgctggtctcacagctaaagattgtcctcaatgtttcaaccaaaaactacaatggagttctctctattatctatacgctggttgagatttttcaaaatattggtgataccaatcttgctgatttcactgctggattgctcaccattgtcgtctgtatggcagttaaggaattaaatgatcggtttagacacaaaatcccagtccctattcctatagaagtaattgtgacgataattgctactgccatttcatatggagccaacctggaaaaaaattacaatgctggcattgttaaatccatcccaagggggtttttgcctcctgaacttccacctgtgagcttgttctcggagatgctggctgcatcattttccatcgctgtggtggcttatgctattgcagtgtcagtaggaaaagtatatgccaccaagtatgattacaccatcgatgggaaccaggaattcattgcctttgggatcagcaacatcttctcaggattcttctcttgttttgtggccaccactgctctttcccgcacggccgtccaggagagcactggaggagttgctggcatcatctctgctgcgattgtgatgatcgccattcttgccctggggaagcttctggaacccttgcagaagtcggtcttggcagctgttgtaattgccaacctgaaagggatgtttatgcagctgtgtgacattcctcgtctgtggagacagaataagattgatgctgttatctgggtgtttacgtgtatagtgtccatcattctggggctggatctcggtttactagctggccttatatttggactgttgactgtggtcctgagagttcagtttccttcttggaatggccttggaagcatccctagcacagatatctacaaaagtaccaagaattacaaaaacattgaagaacctcaaggagtgaagattcttagattttccagtcctattttctatggcaatgtcgatggttttaaaaaatgtatcaagtccacagttggatttgatgccattagagtatataataagaggctgaaagcgctgaggaaaatacagaaactaataaaaagtggacaattaagagcaacaaagaatggcatcataagtgatgctgtttcaacaaataatgcttttgagcctgatgaggatattgaagatctggaggaacttgatatcccaaccaaggaaatagagattcaagtggattggaactctgagcttccagtcaaagtgaacgttcccaaagtgccaatccatagccttgtgcttgactgtggagctatatctttcctggacgttgttggagtgagatcactgcgggtgattgtcaaagaattccaaagaattgatgtgaatgtgtattttgcatcacttcaagattatgtgatagaaaagctggagcaatgcgggttctttgacgacaacattagaaaggacacattctttttgacggtccatgatgctatactctatctacagaaccaagtgaaatctcaagagggtcaaggttccattttagaaacgatcactctcattcaggattgtaaagatacccttgaattaatagaaacagagctgacggaagaagaacttgatgtccaggatgaggctatgcgtacacttgcatcctgaaagtgggttcgggaggtctctatgagcaaggaatacaagacaaaacttcctcaatgcattgactatttcttcagactcaaaacactcattcttttttctattaagccattgaaagagaagcactaagactgcttctaggctttatttataaaataaacaccttatccctaacatgggcaaaatggctagaattattcagacgatttggcagcgtccagggtaagctggtgttataatacgctgctgatctacatcacagatttgctaataatgttcacgtgggccctggcatatctctgttcagttagagtgagtgctgacccaacagcctctgtggtcaagcgagtcacgaatgattaatcataaagaaaaatcagtttttgactgacctggatatccatgagctgcactgatcaccatgtaaggtcacatttagtaaatgctgaaataaaatgattaatgcatttatcaataaaagcctttgaaaatactttggataataaattggagttttaaaaatgcaaatttgcttagtatctaataatgaagtgttattacatatagccggaattgaggatctctttgatcctggaaatggtttacctaaaagctacagaaccaggccaatatattttgaaatattgatgcagacaaatgaaataataaagagattttcatggtttataaaaatcttttttgatatgataataatcatgatcacaactgagatcaaaaaaatatatgacagattattttgtttaaaaatgcagttttaattatcttagtctatagaaatgatcattgcatggaggcatgtataggtatgatctgtgtaaaatctgacataaaaacagtgctattctgagtgaaaatttttttgatgtgcttacataaccatggtgattaaaatgagtttatattttttctcaaaaattttagcagtgtgtaaagtaagtaatctttaactgaactctgaccacttaaaaaaaaatctaaaaattgaactacctatagtagtctgtgtttaaagtgaatttttaaagacaaagcattctaaatgaactcaatataaaaacattcatttggaatgtacatactgaaaaatacaggtttttttgaccaaaagtttttatatcttttctttttatttatttttttcctaagtgccaacaattttctagatattatatacaacacaggctttgatcttggggacttttcccatatatttcacactggagtgaatgaagttgtacttcatttctagagaaaagttatacccaggtccccaattgagaatgtcttgcttgattgaaaacgacatcatcccttggtatactccagggattggtttcaggacccctgcatttaccaaaatttgtgcacactcaagtcctgcagtcacccctgcctaaagatagaatggcttctctgtttttcttctgaaatacaaccagaaacaatgtgtctatttctgaaagaataggattaatgatcatacaaatgggttaatcctgaattctggttgtaaatctggttacagcataactaggattataatgctgcctcattttcacagcactacttgcttatattgacaacaaatcatctcgctaaagagtgaatgtaggccaggcgcggtggctcatgcctgtaatcccagcactttgggaggccgaggcgggtggatcacgaggtcaggagatcgagaccatcctggctaacatggtaaaaccccgtctctactaaaaatagaaaaaaagaaattagcctagcgtggtggctggcgggcgcctgtagtcccagctatttgggaggctaaggcaggagaatggcgtgaacccgggaggcggagcttgcagtgagccgaggtcgtgccactgcactccagcctgggcgacagagcaagactccgtctcaaaaaaaaaaaaaaaaaaaaaaaaagagtgaatgtaatagtcttgcagaaaatgaatgaatacctttgttcaataaaggaaatatgcactgctcacttttttgaaggaaatgccaaagttacgttttacaacaaggctagagtttgtaaattctgggttcatttgtgatgacataagtcagcaaactgcgggaatactgtctcttctatgtattttgtgaatagtaagcataattttagttttgtattatcaatgaaaatttcacttgaaattaaagctgccttttgttatatttttaacctataggataagattccagtattgtatatgagttttaacaaattaaaaaatcaaatcatgtacatttgaaaatatttgcacacatttaaaaataaatgtaaagttgtcttttaaactactcggatgtgtcctttctgaacaaaa

SEQ ID NO: 291878 - DNA, 3841 bp, Homo sapiens
ggcatgggagttttcattcttaatgtacttcctgaaatactcagcgaaggtcttgcaaagattcaatttgtaggatcgttgtcatccagtctcttccttaggaattcattgcctttgggatcagcaacatcttctcaggattcttctcttgttttgtggccaccactgctctttcccgcacggccgtccaggagagcactggaggacgattttaatatagtggccaaaatgagccttggcctcccataattggagactcattatgacatataattggcaagtaggtggccactctcctggcatgagtttggcagctgactgtggtccttgtccccaaatctccatatctttctccagttcacagagctccccatccacagtgagatgcaagtggctcggttgctggcatcatctctgctgcgattgtgatgatcgccattcttgccctggggaagcttctggaacccttgcagaagtcggtcttggcagctgttgtaattgccaacctgaaagggatgtttatgcagctgtgtgacattcctcgtctgtggagacagaataagattgatgctgttatctgggtgtttacgtgtatagtgtccatcattctggggctggatctcggtttactagctggccttatatttggactgttgactgtggtcctgagagttcagtttccttcttggaatggccttggaagcatccctagcacagatatctacaaaagtaccaagaattacaaaaacattgaagaacctcaaggagtgaagattcttagattttccagtcctattttctatggcaatgtcgatggttttaaaaaatgtatcaagtccacagttggatttgatgccattagagtatataataagaggctgaaagcgctgaggaaaatacagaaactaataaaaagtggacaattaagagcaacaaagaatggcatcataagtgatgctgtttcaacaaataatgcttttgagcctgatgaggatattgaagatctggaggaacttgatatcccaaccaaggaaatagagattcaagtggattggaactctgagcttccagtcaaagtgaacgttcccaaagtgccaatccatagccttgtgcttgactgtggagctatatctttcctggacgttgttggagtgagatcactgcgggtgattgtcaaagaattccaaagaattgatgtgaatgtgtattttgcatcacttcaagattatgtgatagaaaagctggagcaatgcgggttctttgacgacaacattagaaaggacacattctttttgacggtccatgatgctatactctatctacagaaccaagtgaaatctcaagagggtcaaggttccattttagaaacgatcactctcattcaggattgtaaagatacccttgaattaatagaaacagagctgacggaagaagaacttgatgtccaggatgaggctatgcgtacacttgcatcctgaaagtgggttcgggaggtctctatgagcaaggaatacaagacaaaacttcctcaatgcattgactatttcttcagactcaaaacactcattcttttttctattaagccattgaaagagaagcactaagactgcttctaggctttatttataaaataaacaccttatccctaacatgggcaaaatggctagaattattcagacgatttggcagcgtccagggtaagctggtgttataatacgctgctgatctacatcacagatttgctaataatgttcacgtgggccctggcatatctctgttcagttagagtgagtgctgacccaacagcctctgtggtcaagcgagtcacgaatgattaatcataaagaaaaatcagtttttgactgacctggatatccatgagctgcactgatcaccatgtaaggtcacatttagtaaatgctgaaataaaatgattaatgcatttatcaataaaagcctttgaaaatactttggataataaattggagttttaaaaatgcaaatttgcttagtatctaataatgaagtgttattacatatagccggaattgaggatctctttgatcctggaaatggtttacctaaaagctacagaaccaggccaatatattttgaaatattgatgcagacaaatgaaataataaagagattttcatggtttataaaaatcttttttgatatgataataatcatgatcacaactgagatcaaaaaaatatatgacagattattttgtttaaaaatgcagttttaattatcttagtctatagaaatgatcattgcatggaggcatgtataggtatgatctgtgtaaaatctgacataaaaacagtgctattctgagtgaaaatttttttgatgtgcttacataaccatggtgattaaaatgagtttatattttttctcaaaaattttagcagtgtgtaaagtaagtaatctttaactgaactctgaccacttaaaaaaaaatctaaaaattgaactacctatagtagtctgtgtttaaagtgaatttttaaagacaaagcattctaaatgaactcaatataaaaacattcatttggaatgtacatactgaaaaatacaggtttttttgaccaaaagtttttatatcttttctttttatttatttttttcctaagtgccaacaattttctagatattatatacaacacaggctttgatcttggggacttttcccatatatttcacactggagtgaatgaagttgtacttcatttctagagaaaagttatacccaggtccccaattgagaatgtcttgcttgattgaaaacgacatcatcccttggtatactccagggattggtttcaggacccctgcatttaccaaaatttgtgcacactcaagtcctgcagtcacccctgcctaaagatagaatggcttctctgtttttcttctgaaatacaaccagaaacaatgtgtctatttctgaaagaataggattaatgatcatacaaatgggttaatcctgaattctggttgtaaatctggttacagcataactaggattataatgctgcctcattttcacagcactacttgcttatattgacaacaaatcatctcgctaaagagtgaatgtaggccaggcgcggtggctcatgcctgtaatcccagcactttgggaggccgaggcgggtggatcacgaggtcaggagatcgagaccatcctggctaacatggtaaaaccccgtctctactaaaaatagaaaaaaagaaattagcctagcgtggtggctggcgggcgcctgtagtcccagctatttgggaggctaaggcaggagaatggcgtgaacccgggaggcggagcttgcagtgagccgaggtcgtgccactgcactccagcctgggcgacagagcaagactccgtctcaaaaaaaaaaaaaaaaaaaaaaaaagagtgaatgtaatagtcttgcagaaaatgaatgaatacctttgttcaataaaggaaatatgcactgctcacttttttgaaggaaatgccaaagttacgttttacaacaaggctagagtttgtaaattctgggttcatttgtgatgacataagtcagcaaactgcgggaatactgtctcttctatgtattttgtgaatagtaagcataattttagttttgtattatcaatgaaaatttcacttgaaattaaagctgccttttgttatatttttaacctataggataagattccagtattgtatatgagttttaacaaattaaaaaatcaaatcatgtacatttgaaaatatttgcacacatttaaaaataaatgtaaagttgtcttttaaactactcggatgtgtcctttctgaacaaaa

SEQ ID NO: 291879 - DNA, 502 bp, Homo sapiens
tgaacaacattcctgcagaattccctggagtgagactcaggacaatattaaatccaatgaatcacgcagctttcaggagggcagggcagcacgctgcagagcagcactgaatgatggcttggcctggcgtccctggtggcagcagtggccgcaccaggcaccgtgttctcattcaacaaagactcagttttgatgtgaggactgtgaacatctccagaacaggagacatttggaagagcttgtgcccactggtatctgaaacttggctgctcattcttcagaaaccccttgtatcctgctatgattcctcagcaacaccatcacatggaaaagaaccaacaatgtgaagaaacgaatatggtgttcattttcaaactgaaaaaggaaataattacagttactatttacagtgtctggcttttcaagcttcatgctacaagcagctaactctttgtcaaacaattaattttgtttaaaataaataagtttatatatttaaagt

SEQ ID NO: 291880 - DNA, 655 bp, Homo sapiens
tgaacaacattcctgcagaattccctggagtgagactcaggacaatattaaatccaatgaatcacgcagctttcaggagggcagggcagcacgctgcagagcagcactgaatgatggcttggcctggcgtccctggtggcagcagtggccgcaccaggcaccgtgttctcattcaacaaagactcagctggcacagagctttagcaccttaagttgctcaatttgatctctgcactcaggaacaagaatcttcctggtttgtggaaagagtgctattctgacattggatgctgctgagaatcgggcaacagtcttagtgaggtgaccatcatctgaggagttttgatgtgaggactgtgaacatctccagaacaggagacatttggaagagcttgtgcccactggtatctgaaacttggctgctcattcttcagaaaccccttgtatcctgctatgattcctcagcaacaccatcacatggaaaagaaccaacaatgtgaagaaacgaatatggtgttcattttcaaactgaaaaaggaaataattacagttactatttacagtgtctggcttttcaagcttcatgctacaagcagctaactctttgtcaaacaattaattttgtttaaaataaataagtttatatatttaaagt

SEQ ID NO: 291881 - DNA, 337 bp, Homo sapiens
tgaacaacattcctgcagaattccctggagtgagactcaggacaatattaaatccaatgaatcacgcagctttcaggagggcagggcagcacgctgcagagcagcactgaatgatggcttggcctggcgtccctggtggcagcagtggccgcaccaggcaccgtgttctcattcaacaaagactcaggttagtgagcgagatgcctgtaccaaatctcccttccctctttttcaagtttctggatgttgtgtaattcttttttgcagcattcagttctgcaaggagcctagtgaatgcttccatcagtggactatgaaaggcatctggacaagcagt

SEQ ID NO: 291882 - DNA, 1390 bp, Homo sapiens
agagcagtgtcctaggaagtaggtaccctgcctcaaatgggcacttacccaggtaggcagtgagtgatatttctggaaggatcacattcccatctctctaatatgagtataacagtctcatctggatatggaaaaaagattattcagagccaacaaatctggctataggctgtttcactttctctgaaactcatccagtctgacaccagttcacaaagaacacctgtgattccagtctgatctaggcaactctagctgctttcccactaccctcaggtttgccttgtcagccatggatatggaacagaaagactatgactcgcgcacagctctgcatgttgctgcagctgaaggtactgaagggttaaggaggggaggaggagggtaatcataagaccctttctttttcaccaaaagtaccttcattatatgtgccctcaaggttataggggcagcaactagttttatctagacacccttcggtttgcagctagactatgactgagtgctgcagggtacaaaatgggaagaggccttttcccctcccctcttggtaaagacttcagtggctaagtgtctgcaccaaagggttcaagacctgcgccttctcattttccttctgcccatattcctaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatc

SEQ ID NO: 291883 - DNA, 1167 bp, Homo sapiens
  misc_feature (3)..(3): n is a, c, g, or t
cgnggtgttgctcctgaattgtgcttcacattgctggctcttctccttggggtctcagcttagatgtcatttccaaagaaagacttttctgaccaccctatctcatgtggcccccctctacctctatttacagcaccctacttctcactatttatcacaattactttaaaaattacgtgtctatttatttacctgtttattacctatctcctaacaccagaatggaagttcctagttctagcacagcatctagcacagaatgctgtaagtatttcaaaaaatattttctagctgaatcaatgaatttaagggaaggaaaggacaggagtaataaaagaagctaattaacaagccaaaaggttgaggtggattgtggtcatgcagtcatttgtaaacttgttaagagtacagcctaacttgtttattttctgatttggggcacacccactttatcctcagcttcagttctgttccccaggtgggcctgccagccaagtcagctgtatcaggagccatcctcctggtggtacccaatgtcatgggaatgatgtgcctgtcacccccattggacaagctggggaacagccatagggggaccagcttctgccaggtgagatgctttgcatatagtacttactatttttgaagcaataaatttgtttaatggtaccacttttactataataaagcaattttgagctcctactaagtgtaaggagtaaataaacaatatatttggcttacaattctagaagttggtgtctctcttcaatttccacaactatgacaacctgaggcactgtgctcggaagttagacccacggcgtgaaggggcagaaattcgggtaaggaaaactccaggtggcttgtaagaatatttcaaaggccaggtgcggtggctcacgcctgtaatccctgcactttgagaggccaaggcgggcggatcacaaggtcaggagatcaagaccatcctggctaacacggtgaaacctggtctctattgaaaatacaaaaaattagccagacgtggtggcacgcgcctgtggtcccagctacttgggaggctgaggcaggagaatcgcttgaaaccgggaggcagaggttgcagtgagccaagaccgcgcgccactacacttcagcctgaacgacagagcgagactccgtctc

SEQ ID NO: 291884 - DNA, 2465 bp, Homo sapiens
gaatttgggaattgtatagttcaattcctcattttattttattacttattacataagttatacatgaatactcatcataagagttcaaacaatatagaaatacatgttctcctttccctccctactcaatccctgtcctcttttcccagaagtaaatattagcagattagtgggtatcttctagataatgtcctatgtactgacatacatacatgaatatatataaatatacttttatgatttaggattttttaaatatcaaggtaacatacatacatattattctggtatttattttttttctcatatcccaagacatagtgtctttccacatcattaaaacccctcattttagaggtacggaaactaagacctagaaaggtaaactgatttgccaaaggtaacagagctgttgatcccaaacctgaagaccactcaaccttctttattcccaatttccgtggctccagagtgagtcccagctgcatttctctagccccctaatccaatcgtgtctgggatccaggtgtgtgagcagcaacattgtgctcctgacccaggcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatc

SEQ ID NO: 291885 - DNA, 2492 bp, Homo sapiens
cacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatc

SEQ ID NO: 291886 - DNA, 1874 bp, Homo sapiens
aacaggctgtacgccccggaagtatgggatgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgttgcagtatctcaacaaaatggctgggaatgaatacatgggtttcagcaatgccactgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatc

SEQ ID NO: 291887 - DNA, 4489 bp, Homo sapiens
cacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgtgtgagcagcaacattgtgctcctgacccaggcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccaggtgagatgctttgcatatagtacttactatttttgaagcaataaatttgtttaatggtaccacttttactataataaagcaattttgagctcctactaagtgtaaggagtaaataaacaatatatttggcttacaattctagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatcatttttgctaaacccagtccttctttcttccctaggggtatctagcttcatcaccatcatagaaggtagaaaaagatggaatcacagggtcaaagcacagcttctctacctaccctaccaaacagtacatattcacttaccccaccaggtttttctcaactccaaatactgctttaggttaagtgtattctgctgccaagggaagcataggtttgagtctaaacaggctctgaaacagattgtgcaaaacctcaggcctccttccttcctcgggaagttccaactgtggcagaaatgaagatggaacttctcaagaataaacagttttggccgggtgtggtggctcacgcctgaaatcccagcactttgggaggccaaggtgggctgatcacatgaggccaggagttcgagaccagcctggccaatatggcaaaaccccatctctactaaaaatataaaaatgagacgggcatggtggcacacacctgtaatcctagctactcaggaggctgaggcacgagagtcgcttgaacccaaaaggcagagtttgcagtgagccaagatcatgccactgcactccagcctgggtgacagagtgagactctgtctcaaaaataaataaatagtttctagcactcatcccctagatatcccccaagtgtctctcttcccctttggtcaaggttataactgggataatgattatgacagactggctgggtgtcagaggtacagatttaaggtagatggactcagggtaaggatagctacagctgtgtggggctgaaggtctgtggcactgagctactggggaaggagggctctgttttcattttgacacactgagttaataaagcacttactgagggagccagagcccaaactctaaatgtgctgtagaaaaagggccaagtcattgactgcaccactccttcagccagaggtagaaaggatttactcttcagccatctggtagagccccaagaacaagttacatgtggacaaagggagggagaggtatcatggtgattaataaattcaaacaaagctgaatgataagaccccaggatggaatacagtctgagaaaggcctgggcaaagggaggcagagggactgaaggaagcaggtcaaggaagatacacccatggtagcctaggaaattggcagtagtgttggtgggtggggaaaaggagggtttggctgtatgcctagctttcacaaggtaggggatgaggaagatgatcatgatattgcacagaggacccaacactgaattgtgggagctagaggttgcttgaggcaaagtaaaaaggcttcggacactttcaaaaggaggctggccaaaggcgtgattagggactccagtaatggacatactagaggccctcgggcacctcaagccctgaatgggtcagcagctccccatcccagagagcaaaggcaggcaccactggaccccggaaatctgtctgtagcgtgtgaaccacagagacctggctcacatccaccaggctcagcttctgggcctcatactccagcaacagccccaccttctctggctgcccaataccctcaactggggctttctcgttggccaacatggtgtaccacttgcgctgggcataggtgaacacccaggaacgatcatcaacaccaatgcagctatcccgggacatgtccacatctgccactcctatccggaactgctgggagcgcttcactgtcacttcccagtagtgtctgccactggtgaccgctgtgtctgccagcaccac

SEQ ID NO: 291888 - DNA, 663 bp, Homo sapiens
ttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcagtaaggctcctgggacagggcaggggacgggcttgcccccactcccactgtggttctcgctagttcccgagtgcccttccaaggcagcgccgctcatctcccctctcctcgctcactagccctcggtgccttttcctttggatgtggggctttgggtgcgccgcgctcgggcggtaatctgccgtctgcctaggagtgcgttcgggcaagcgggtcctggggatg

SEQ ID NO: 291889 - DNA, 2622 bp, Homo sapiens
cacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgtgtgagcagcaacattgtgctcctgacccaggcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatc

SEQ ID NO: 291890 - DNA, 4398 bp, Homo sapiens
cacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgtgtgagcagcaacattgtgctcctgacccaggcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatcatttttgctaaacccagtccttctttcttccctaggggtatctagcttcatcaccatcatagaaggtagaaaaagatggaatcacagggtcaaagcacagcttctctacctaccctaccaaacagtacatattcacttaccccaccaggtttttctcaactccaaatactgctttaggttaagtgtattctgctgccaagggaagcataggtttgagtctaaacaggctctgaaacagattgtgcaaaacctcaggcctccttccttcctcgggaagttccaactgtggcagaaatgaagatggaacttctcaagaataaacagttttggccgggtgtggtggctcacgcctgaaatcccagcactttgggaggccaaggtgggctgatcacatgaggccaggagttcgagaccagcctggccaatatggcaaaaccccatctctactaaaaatataaaaatgagacgggcatggtggcacacacctgtaatcctagctactcaggaggctgaggcacgagagtcgcttgaacccaaaaggcagagtttgcagtgagccaagatcatgccactgcactccagcctgggtgacagagtgagactctgtctcaaaaataaataaatagtttctagcactcatcccctagatatcccccaagtgtctctcttcccctttggtcaaggttataactgggataatgattatgacagactggctgggtgtcagaggtacagatttaaggtagatggactcagggtaaggatagctacagctgtgtggggctgaaggtctgtggcactgagctactggggaaggagggctctgttttcattttgacacactgagttaataaagcacttactgagggagccagagcccaaactctaaatgtgctgtagaaaaagggccaagtcattgactgcaccactccttcagccagaggtagaaaggatttactcttcagccatctggtagagccccaagaacaagttacatgtggacaaagggagggagaggtatcatggtgattaataaattcaaacaaagctgaatgataagaccccaggatggaatacagtctgagaaaggcctgggcaaagggaggcagagggactgaaggaagcaggtcaaggaagatacacccatggtagcctaggaaattggcagtagtgttggtgggtggggaaaaggagggtttggctgtatgcctagctttcacaaggtaggggatgaggaagatgatcatgatattgcacagaggacccaacactgaattgtgggagctagaggttgcttgaggcaaagtaaaaaggcttcggacactttcaaaaggaggctggccaaaggcgtgattagggactccagtaatggacatactagaggccctcgggcacctcaagccctgaatgggtcagcagctccccatcccagagagcaaaggcaggcaccactggaccccggaaatctgtctgtagcgtgtgaaccacagagacctggctcacatccaccaggctcagcttctgggcctcatactccagcaacagccccaccttctctggctgcccaataccctcaactggggctttctcgttggccaacatggtgtaccacttgcgctgggcataggtgaacacccaggaacgatcatcaacaccaatgcagctatcccgggacatgtccacatctgccactcctatccggaactgctgggagcgcttcactgtcacttcccagtagtgtctgccactggtgaccgctgtgtctgccagcaccac

SEQ ID NO: 291891 - DNA, 426 bp, Homo sapiens
tctccacatccatctcccttttctctacccactcatgtccaggtggcagcctacatccctcagctggccaagtcaaacccagacctgtggggtgtctccctgtgcactgtggatggtcaacggtgagatgctgggcaagaggaaggggaggcagggcacaggtgccgaacacaggccaacccctttcatggcatctgtctgcctccaggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggtgagcactaccaaggctcagaccgtacttacagctgtccccttctccttatcc

SEQ ID NO: 291892 - DNA, 4239 bp, Homo sapiens
cggggactcggaggtactgggcgcgcgcggctccggggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaa

SEQ ID NO: 291893 - DNA, 4048 bp, Homo sapiens
cggggactcggaggtactgggcgcgcgcggctccggggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaa

SEQ ID NO: 291894 - DNA, 507 bp, Homo sapiens
agcggggcgagagtggaagaccaggggacagaacagaaatccccatggtggccagagtgtcaggtctcatcgtgacgctcttgtcctcctccttcccaggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggtgggtatgttgccttgactacagctgcccctgcctaactacaagtcacccgctgtgtcttgaggctgggtacgggctagtgttctgaagtccctgaaacctagaatgttagaggtggagggaagcataggtagagatctagcccagtgtggccccagagcctgttattcactgcccttcgtgcagattttgtcattcctgtgtactacctgtagtattatttacttgatgttttatttaaattgactcttta

SEQ ID NO: 291895 - DNA, 3637 bp, Homo sapiens
gacatcctcactctctgctaggatgaagtgtggcttccaggatgatgggtgggcccctctgcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaa

SEQ ID NO: 291896 - DNA, 4084 bp, Homo sapiens
cggggactcggaggtactgggcgcgcgcggctccggggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaa

SEQ ID NO: 291897 - DNA, 1895 bp, Homo sapiens
agcggggcgagagtggaagaccaggggacagaacagaaatccccatggtggccagagtgtcaggtctcatcgtgacgctcttgtcctcctccttcccaggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaa
